US007470430B2

(12) United States Patent
Nabel et al.

(10) Patent No.: US 7,470,430 B2
(45) Date of Patent: Dec. 30, 2008

(54) MODIFICATIONS OF HIV, ENV, GAG, AND POL ENHANCE IMMUNOGENICITY FOR GENETIC IMMUNIZATION

(75) Inventors: Gary J. Nabel, Washington, DC (US); Bimal K. Chakrabarti, Gaithersburg, MD (US); Yue Huang, Gaithersburg, MD (US)

(73) Assignee: The United States of America as represented by the Department of Health and Human Services, Washington, DC (US)

(*) Notice: Subject to any disclaimer, the term of this patent is extended or adjusted under 35 U.S.C. 154(b) by 789 days.

(21) Appl. No.: 10/359,120

(22) Filed: Feb. 4, 2003

(65) Prior Publication Data

US 2004/0033487 A1 Feb. 19, 2004

Related U.S. Application Data

(63) Continuation of application No. PCT/US01/25721, filed on Aug. 14, 2001.

(60) Provisional application No. 60/279,257, filed on Mar. 28, 2001, provisional application No. 60/252,115, filed on Nov. 14, 2000, provisional application No. 60/225,097, filed on Aug. 14, 2000.

(51) Int. Cl.
*A61K 39/21* (2006.01)

(52) U.S. Cl. .................................................. 424/208.1

(58) Field of Classification Search ................ 536/23.7; 424/188.1, 208.1
See application file for complete search history.

(56) References Cited

FOREIGN PATENT DOCUMENTS

| | | | |
|---|---|---|---|
| EP | 0 335 635 | A | 10/1989 |
| EP | 0 440 207 | A | 8/1991 |
| EP | 0 449 116 | A | 10/1991 |
| WO | WO 98 41536 | | 10/1998 |
| WO | WO 00 39302 | | 7/2000 |
| WO | WO 02/32943 | A3 | 4/2002 |

OTHER PUBLICATIONS

International Preliminary Examination Report corresponding to International Application No. PCT/US01/25721, filed Aug. 14, 2001.
Advertisment of NIH: "Modifications of HIV Env, Gag and Pol enhance immunogenicity for genetic immunization" Feb. 26, 2001 (http://ott.od.nih.gov/textonly/E-2/5-00.htm).

Andre, S. et al. 1998. Increased immune response elicited by DNA vaccination with a synthetic gp120 sequence with optimized codon usage. *J. Virol*. 72:1497-1503.

Binley, J. M. et al. 1998. Analysis of the interaction of antibodies with a conserved enzymatically deglycosylated core of the HIV type 1 envelope glycoprotein 120. *AIDS Res. Hum. Retrovir*. 14:191-198.

Binley, J. M. et al. 2000. A recombinant human immunodeficiency virus type 1 envelope glycoprotein complex stabilized by an intermolecular disulfide bond between the gp120 and gp41 subunits is an antigenic mimic of the trimeric virion-associated structure. *J. Virol*. 74:627-643.

Binley, J., and J. P. Moore. 1997. HIV-cell fusion. The viral mousetrap. *Nature* 387:346-348.
Bolognesi, D. P., and T. J. Matthews. 1998. HIV vaccines. Viral envelope fails to deliver? *Nature* 391:638-639.

Borrow, P. et al. 1994. Virus-specific CD8+ cytotoxic T-lymphocyte activity associated with control of viremia in primary human immunodeficiency virus type 1 infection. *J. Virol*. 68:6103-6110.

Broder, C. C. et al. 1994. Antigenic implications of human immunodeficiency virus type 1 envelope quaternary structure: oligomer-specific and -sensitive monoclonal antibodies. *Proc. Natl. Acad. Sci. USA* 91:11699-11703.

Bures, R. et al. 2000. Immunization with recombinant canarypox vectors expressing membrane-anchored glycoprotein 120 followed by glycoprotein 160 boosting fails to generate antibodies that neutralize R5 primary isolates of human immunodeficiency virus type 1. *AIDS Res. Hum. Retrovir*. 16:2019-2035.

Burton, D. R., and D. C. Montefiori. 1997. The antibody response in HIV-1 infection. *AIDS* 11(Suppl. A):S87-S98.

Cao, Y. et al. 1995. Virologic and immunologic characterization of long-term survivors of human immunodeficiency virus type 1 infection. *N Engl. J. Med*. 332:201-208.

Chakrabarti B.K. et al. 2002. Modifications of the Human Immunodeficiency Virus Envelope Glycoprotein Enhance Immunodeficiency for Genetic Immunization. *J. Virol*. 76:5357-5368.

Chan, D. C. et al. 1997. Core structure of gp41 from the HIV envelope glycoprotein. *Cell* 89:263-273.

Chen, C., and H. Okayama. 1987. High-efficiency transformation of mammalian cells by plasmid DNA. *Mol. Cell. Biol*. 7:2745-2752.

Collins, J. L. et al. 1981. Tumorigenicity and lysis by natural killers. *J. Exp. Med*. 153:89-106.

Connor, R. I. et al. 1998. Immunological and virological analysis of persons infected by human immunodeficiency virus type 1 while participating in trials of recombinant gp120 subunit vaccines. *J. Virol*. 72:1552-1576.

Dale and Betty Bumpers Vaccine research Center (NIH), Laboratory of Virology, Research Summary, Jan. 25, 2001. (http://www.niaid.nih.gov/vrc/nabel/htm).

Eckert, D. M. et al. 1999. Inhibiting HIV-1 entry: discovery of D-peptide inhibitors that target the gp41 coiled-coil pocket. *Cell* 99:103-115.

Evans, T. G. et al. 1999, A canarypox vaccine expressing multiple human immunodeficiency virus type 1 genes given alone or with rgp120 elicits broad and durable CD8+ cytotoxic T lymphocyte responses in seronegative volunteers. *J. Infect. Dis*. 180:290-298.

(Continued)

*Primary Examiner*—Jeffrey S. Parkin
(74) *Attorney, Agent, or Firm*—Knobbe, Martens, Olson & Bear, LLP

(57) ABSTRACT

Modified HIV Env, Gag, Pol, or Nef DNA with improved ability to elicit antibody and CTL responses to HIV antigens have been identified as prototype immunogens for the treatment and prevention of HIV infections. Modifications to Env glycoprotein include deletions in the cleavage site, fusogenic domain, and spacing of heptad repeats 1 and 2 and different COOH-terminal deletions. Other modifications entail expression of Gag-Pol and Gag-Pol-Nef as fusion proteins.

5 Claims, 190 Drawing Sheets
(177 of 190 Drawing Sheet(s) Filed in Color)

OTHER PUBLICATIONS

Ferrari, G. et al. 1997. Replication-defective canarypox (ALVAC) vectors effectively activate anti-human immunodeficiency virus-1 cytotoxic T lymphocytes present in infected patients: implications for antigen-specific immunotherapy. *Blood* 90:2406-2416.

Gallaher, W. R. et al. 1989. A general model for the transmembrane proteins of HIV and other retroviruses. *AIDS Res. Hum. Retrovir.* 5:431-440.

Gauduin, M. C. et al. 1997. Passive immunization with a human monoclocal antibody protects hu-PBL-SCID mice against challenge by primary isolates of HIV-1. *Nat. Med.* 3:1389-1393.

Gorse, G. J. et al. 1999. Vaccine-induced cytotoxic T lymphocytes against human immunodeficiency virus type 1 using two complementary in vitro stimulation strategies. *Vaccine* 18:835-849.

Graham, F. L., and A. J. van der Eb. 1973. A new technique for the assay of infectivity of human adenovirus 5 DNA. *Virology* 52:456-467.

Haynes, B. F. 1996. HIV vaccines: where we are and where we are going. *Lancet* 348:933-937.

Hosmalin, A. et al. 1990. An epitope in human immunodeficiency virus 1 reverse transcriptase recognized by both mouse and human cytotoxic T lymphocytes. *PNAS USA* 87:2344-2348.

Huang Y. et al. 2001. Human Immunodeficiency Virus Type 1-Specific Immunity after Genetic Immunization is Enhanced by Modification of Gag and Pol Expression. *J. Virol.* 75:4947-4951.

Hung, M., P. Patel, S. Davis, and S. R. Green. 1998. Importance of ribosomal frameshifting for human immunodeficiency virus type 1 particle assembly and replication. *J. Virol.* 72:4819-4824.

Irwin, M. J. et al. 1994. Direct injection of a recombinant retroviral vector induces human immunodeficiency virus-specific immune responses in mice and nonhuman primates. *J. Virol.* 68:5036-5044.

Jacks T. et al. 1988 Characterization of ribosomal frameshifting in HIV-I gag-pol expression. Nature 331:280-283.

Jin X. et al. 1999. Dramatic rise in plasma viremia after CD8+ T cell depletion in simian immunodeficiency virus-infected macaques. *J. Exp. Med.* 189:991-998.

Karacostas, V. et al. 1993. Overexpression of the HIV-1 gag-pol polyprotein results in intracellular activation of HIV-1 protease and inhibition of assembly and budding of virus-like particles. *Virology* 193:661-671.

Karlsson, G. B. et al. 1998. The envelope glycoprotein ectodomains determine the efficiency of CD4+ T lymphocyte depletion in simian-human immunodeficiency virus-infected macaques. *J. Exp. Med.* 188:1159-1171.

Kent, K. A., and J. Robinson. 1996. Antigenic determinants on HIV-1 envelope glycoproteins: a dickens of a time with oligomer twist. *AIDS* 10(Suppl. A):S107-S114.

Klein, R. M. et al. 1995. Kinetics of gag-specific cytotoxic T lymphocyte responses during the clinical course of HIV-1 infection: a longitudinal analysis of rapid progressors and long-term asymptomatics. *J. Exp. Med.* 181:1365-1372.

Kotsopoulou E. et al. 2000 A Rev-dependent Human Immunodeficiency Virus type 1 (HIV-1)-based vector that exploits a codon-optimized HIV-1 gag-pol gene. *J. Virol.* 74:4839-4852.

Koup, R. A. et al. 1994. Temporal association of cellular immune responses with the initial control of viremia in primary human immunodeficiency virus type 1 syndrome. *J. Virol.* 68:4650-4655.

LaCasse, R. A. et al. 1999. Fusion-competent vaccines: broad neutralization of primary isolates of HIV. *Science* 283:357-362.

Loeb, D. D. et al. 1989. Complete mutagenesis of the HIV-1 protease. *Nature* 340:397-400.

Lu, M., and P. S. Kim. 1997. A trimeric structural subdomain of the HIV-1 transmembrane glycoprotein. *J. Biomol. Struct. Dyn.* 15:465-471.

Lu, S. et al. 1995. Use of DNAs expressing HIV-1 Env and noninfectious HIV-1 particles to raise antibody responses in mice. *Virology* 209:147-154.

Mangasarian A. et al. 1999 Nef-induced CD4 and Major Histocompatibility Complex class I (MHC-1) down-regulation are governed by distinct determinants: N-terminal alpha helix and proline repeat of Nef selectively regulate MHC-1 trafficking. *J. Virol.* 73:1964-1973.

Manz, R. et al. 1995, Analysis and sorting of live cells according to selected molecules, relocated to a cell-surface affinity matrix. *PNAS USA* 92:1921-1925.

Montefiori, D. C. et al. 1988. Evaluation of antiviral drugs and neutralizing antibodies to human immunodeficiency virus by a rapid and sensitive microtiter infection assay. *J. Clin. Microbiol.* 26:231-235.

Montefiori, D. C. et al. 1996. Neutralizing and infection-enhancing antibody responses to human immunodeficiency virus type 1 in long-term nonprogressors. *J. Infect. Dis* 173:60-67.

Moore, J. P. 1995. HIV vaccines. Back to primary school. *Nature* 376:115.

Moore, J. P. et al. 2001. Genetic subtypes, humoral immunity, and human immunodeficiency virus type 1 vaccine development. *J. Virol.* 75:5721-5729.

Moore, J. P., and D. D. Ho. 1995. HIV-1 neutralization: the consequences of viral adaption to growth on transformed T cells. *AIDS* 9(Suppl. A):S117-S136.

Moss, P. A. H. et al. 1995. Persistant high frequency of human immunodeficiency virus-specific cytotoxic T cells in peripheral blood of infected donors. *PNAS USA* 92:5773-5777.

Musey, L. et al. 1997. Cytotoxic-T-cell responses, viral load, and disease progression in early human immunodeficiency virus type 1 infection. *N. Engl. J. Med.* 337:1267-1274.

Muster, T. et al. 1993. A conserved neutralizing epitope on gp41 of human immunodeficiency virus type 1. *J. Virol.* 67:6642-6647.

Muster, T. et al. 1994. Cross-neutralizing activity against divergent human immunodeficiency virus type 1 isolates induced by the gp41 sequence ELDKWAS. *J. Virol.* 68:4031-4034.

Naldini, L. et al. 1996. In vivo gene delivery and stable transduction of nondividing cells by a lentiviral vector. *Science* 272:263-267.

Ogg, G. S. et al. 1998. Quantitation of HIV-1-specific cytotoxic T lymphocytes and plasma load of viral RNA. *Science* 279:2103-2106.

Ohno, T. et al. 1997. Combination gene transfer to potentiate tumor regression. *Gene Ther.* 4:361-366.

Okuda, K. et al. 1995. Induction of potent humoral and cell-mediated immune responses following direct injection of DNA encoding the HIV type 1 env and rev gene products. *AIDS Res. Hum. Retrovir.* 11:933-943.

Pantaleo, G. et al. 1995. Studies in subjects with long-term nonprogressive human immunodeficiency virus infection. *N. Engl. J. Med.* 332:209-216.

Park, J., and C. D. Morrow. 1992. The nonmyristylated Pr160gag-pol polyprotein of human immunodeficiency virus type 1 interacts with Pr55gag and is incorporated into viruslike particles. *J. Virol.* 66:6304-6313.

Poignard, P. et al. 1996. Antibody neutralization of HIV-1. *Immunol. Today* 17:239-246.

Poumbourios P. et al. 1995 Determinants of Human Immunodeficiency Virus Type 1 envelope glycoprotein oligomeric structure. *J. Virol.* 69:1209-1218.

Qiu, J.-T. et al. 1999. Evaluation of novel human immunodeficiency virus type 1 Gag DNA vaccines for protein expression in mammalian cells and induction of immune responses. *J. Virol.* 73:9145-9152.

Rana, T. M., and K. T. Jeang. 1999. Biochemical and functional interactions between HIV-1 Tat protein and TAR RNA. *Arch. Biochem. Biophys.* 365:175-185.

Reitter, J. N. et al. 1998. A role for carbohydrates in immune evasion in AIDS. *Nat. Med.* 4:679-684.

Research Report EuroVac: European Vaccine Effort against HIV/AIDS, cluster proposal 5-4, Dec. 31, 2000 (http://www.bbw.admin.ch/abstracts/abst2001/html/fp/fp5/51i99.0471-4.html).

Robey, W. G. et al. 1986. Prospect for prevention of human immunodeficiency virus infection: purified 120-kDa envelope glycoprotein induces neutralizing antibody. *Proc. Natl. Acad. Sci. USA* 83:7023-7027.

Roebuck, K. A., and M. Saifuddin. 1999. Regulation of HIV-1 transcription. *Gene Expr.* 8:67-84.

Romano, G. et al. 1999. Regulatory functions of Cdk9 and of cyclin T1 in HIV tat transactivation pathway gene expression. *J. Cell. Biochem.* 75:357-368.

Rowland-Jones, S. L. et al. 1993. HIV-specific cytotoxic T-cell activity in an HIV-exposed but uninfected infant. *Lancet* 341:860-861.

Rowland-Jones, S. L. et al. 1995. HIV-specific cytotoxic T-cells in HIV-exposed but uninfected Gambian women. *Nat. Med.* 1:59-64.

Sanders R.W. et al. 2000 Variable-loop-deleted variants of the Human Immunodeficiency Virus Type 1 envelope glycoprotein can be stabilized by an intermolecular disulfide bond between the gp120 and gp41 subunits. *J. Virol.* 74:5091-5100.

Sattentau, Q. J. 1996. Neutralization of HIV-1 by antibody. *Curr. Opin. Immunol.* 8:540-545.

Sattentau, Q. J. et al. 1995. Epitope exposure on functional, oligomeric HIV-1 gp41 molecules. *Virology* 206:713-717.

Scheffold, A. et al. 1998. Analysis and sorting of T cells according to cytokine expression. *Eur Cytokine Netw.* 9:5-11.

Schmitz, J. E. et al. 1999. Control of viremia in simian immunodeficiency virus infection by CD8+ lymphocytes *Science* 283:857-860.

Schneider, R. et al. 1997. Inactivation of the human immunodeficiency virus type 1 inhibitory elements allows Rev-independent expression of Gag and Gag/protease and particle formation. *J. Virol.* 71:4892-4903.

Seth, A. et al. 1998. Recombinant modified vaccinia virus Ankara-simian immunodeficiency virus gag pol elicits cytotoxic T lymphocytes in rhesus monkeys detected by a major histocompatibility complex class I/peptide tetramer. *PNAS USA* 95:10112-10116.

Seth, A. et al. 2000. Immunization with a modified vaccinia virus expressing simian immunodeficiency virus (SIV) Gag-Pol primes for an anamnestic Gag-specific cytotoxic T-lymphocyte response and is associated with reduction of viremia after SIV challenge. *J. Virol.* 74:2502-2509.

Shibata, R. et al. 1999. Neutralizing antibody directed against the HIV-1 envelope glycoprotein can completely block HIV-1/SIV chimeric virus infections of macaque monkeys. *Nat. Med.* 5:204-210.

Smith, A. J. et al. 1993. Requirements for incorporation of Pr160gag-pol from human immunodeficiency virus type 1 into virus-like particles. *J. Virol.* 67:2266-2275.

Steimer, K. S. et al. 1991. Neutralization of divergent HIV-1 isolates by conformation-dependent human antibodies to Gp120. *Science* 254:105-108.

Sullivan, N. J. et al. 2000. Development of a preventive vaccine for Ebola virus infection. *Nature* 408:605-609.

Tobery T.W. and Siciliano R.F. 1997 Targeting of HIV-I antigens for rapid intracellular degradation enhances cytotoxic T lymphocyte (CTL) recognition and the induction of de novo CTL responses in vivo after immunization. *J. Exp. Med.* 185:909-920.

VanCott, T. C. et al. 1995. Lack of induction of antibodies specific for conserved, discontinuous epitopes of HIV-1 envelope glycoprotein by candidate AIDS vaccines. *J. Immunol.* 155:4100-4110.

Vinner L. et al. 1999 Gene gun DNA vaccination with Rev-independent synthetic HIV-1 p. 160 envelope gene using mammalian codons. *Vaccine* 17(17):2166-2175.

Walker, B. D. et al. 1988. HIV-1 reverse transcriptase is a target for cytotoxic T lymphocytes in infected individuals. *Science* 240:64-66.

Wang, B. et al. 1993. Gene inoculation generates immune responses against human immunodeficiency virus type 1. *PNAS USA* 90:4156-4160.

Weissenhorn, W. et al. 1996. The ectodomain of HIV-1 env subunit gp41 forms a soluble, alpha-helical, rod-like oligomer in the absence of gp120 and the N-terminal fusion peptide. *EMBO J.* 15:1507-1514.

Weissenhorn, W. et al. 1997. Atomic structure of the ectodomain from HIV-1 gp41. *Nature* 387:426-430.

Wilson, W. et al. 1988. HIV expression strategies: ribosomal frameshifting is directed by a short sequence in both mammalian and yeast systems. *Cell* 55:1159-1169.

Xu, L. et al. 1998. Immunization for Ebola virus infection. *Nat. Med.* 4:37-42.

Yang, O. et al. 1996. Efficient lysis of human immunodeficiency virus type 1-infected cells by cytotoxic T lymphocytes. *J. Virol.* 70:5799-5806.

Yang, X. et al. 2000. Characterization of stable, soluble trimers containing complete ectodomains of human immunodeficiency virus type 1 envelope glycoproteins. *J. Virol.* 74:5716-5725.

Yang, Z. et al. 1998. Distinct cellular interactions of secreted and transmembrane Ebola virus glycoproteins. *Science* 279:1034-1037.

York, J. et al. 2001. Antibody binding and neutralization of primary and T-cell line-adapted isolates of human immunodeficiency virus type 1. *J. Virol.* 75:2741-2752.

zur Megede, J. et al. 2000. Increased expression and immunogenicity of sequence-modified human immunodeficiency virus type 1 gag gene. *J. Virol.* 74:2628-2635.

A Ebola GP2

B MoMuLv Mo-55

C low-pH-treated influenza HA2

D protease resistant core of HIV gp41

E SIV gp41 (NMR)

F SNAREs

FIG. 177

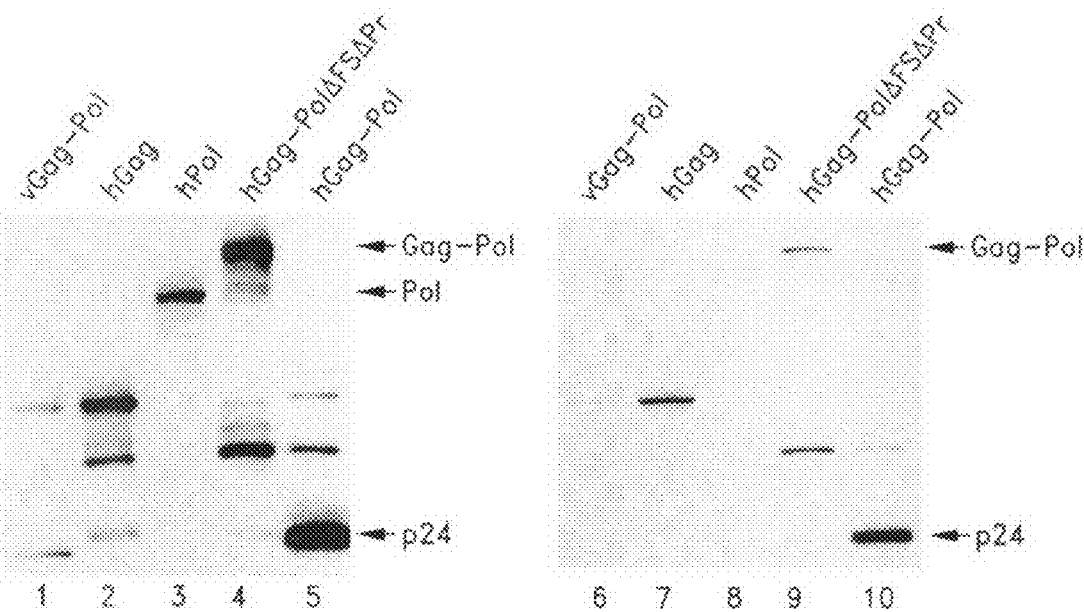
FIG. 185A
FIG. 185B
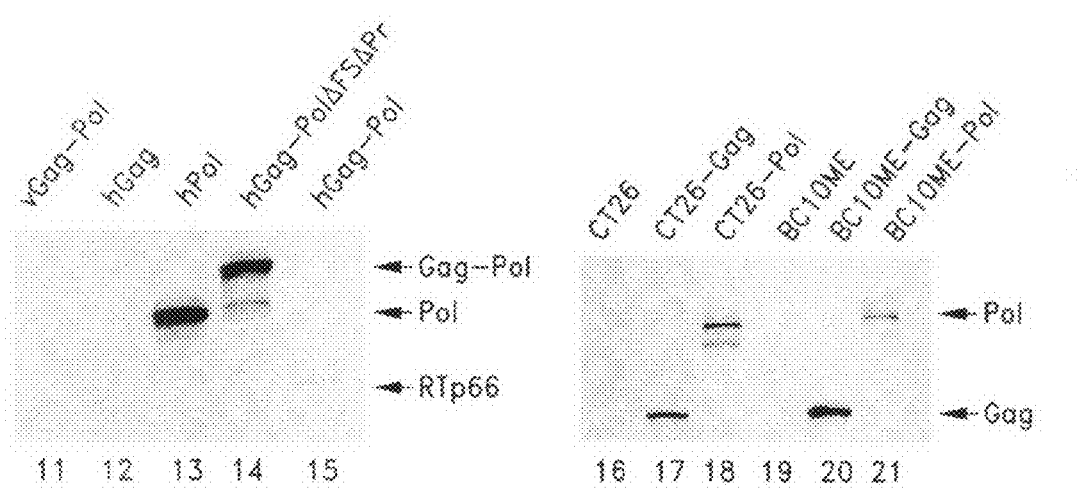
FIG. 185C
FIG. 185D

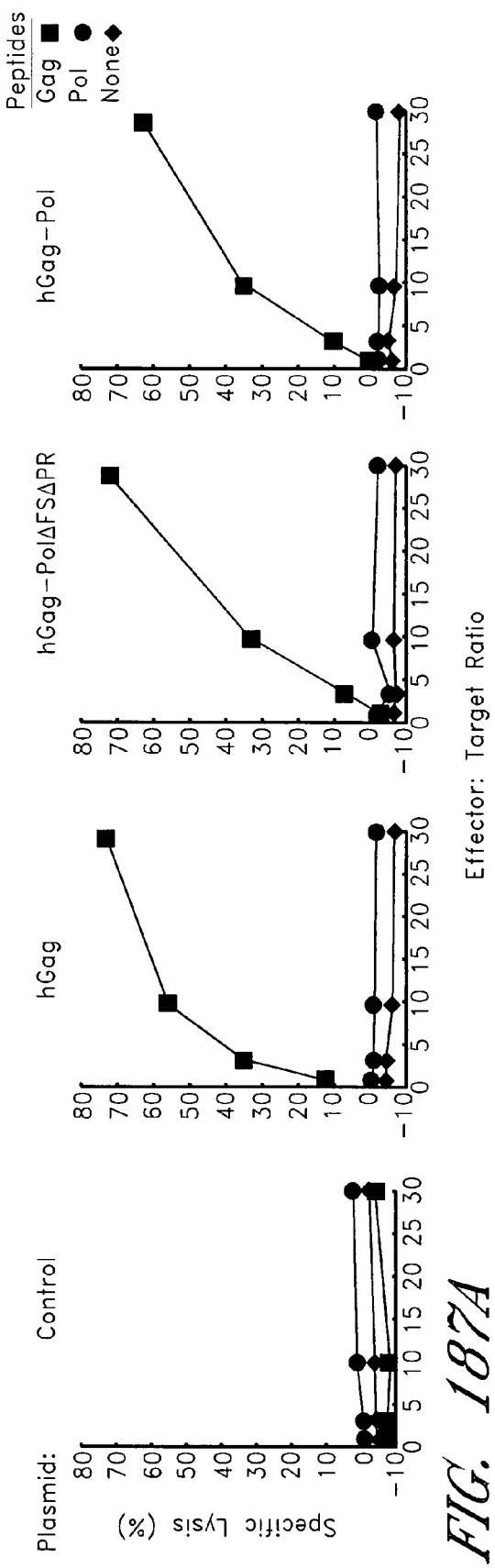
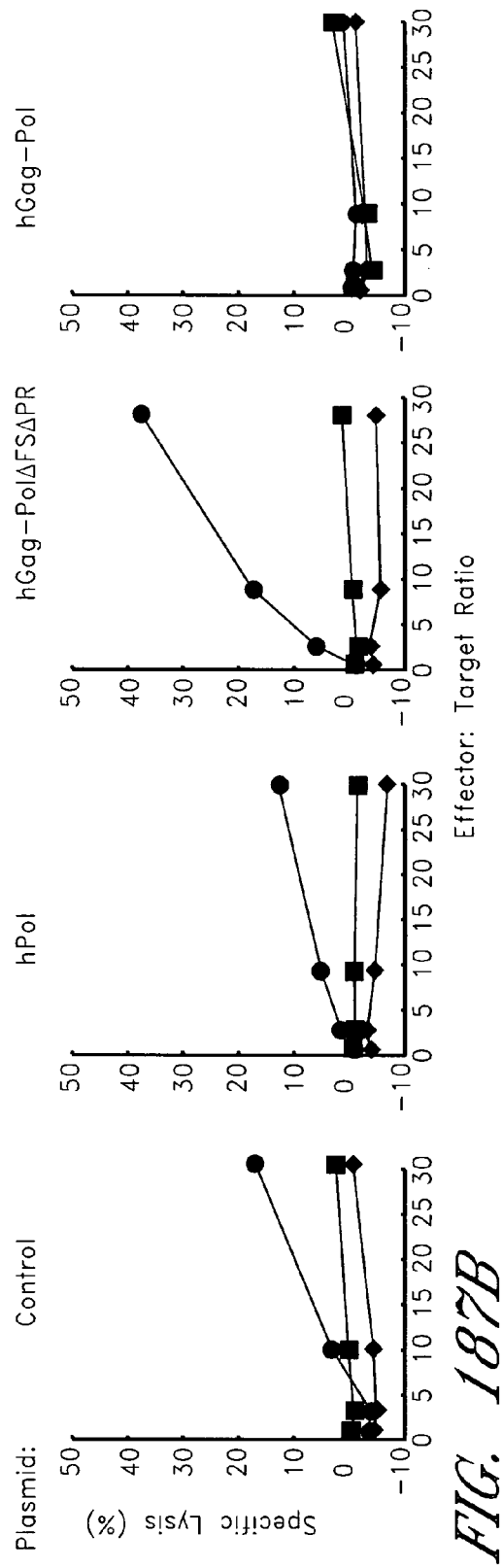
FIG. 187A
FIG. 187B

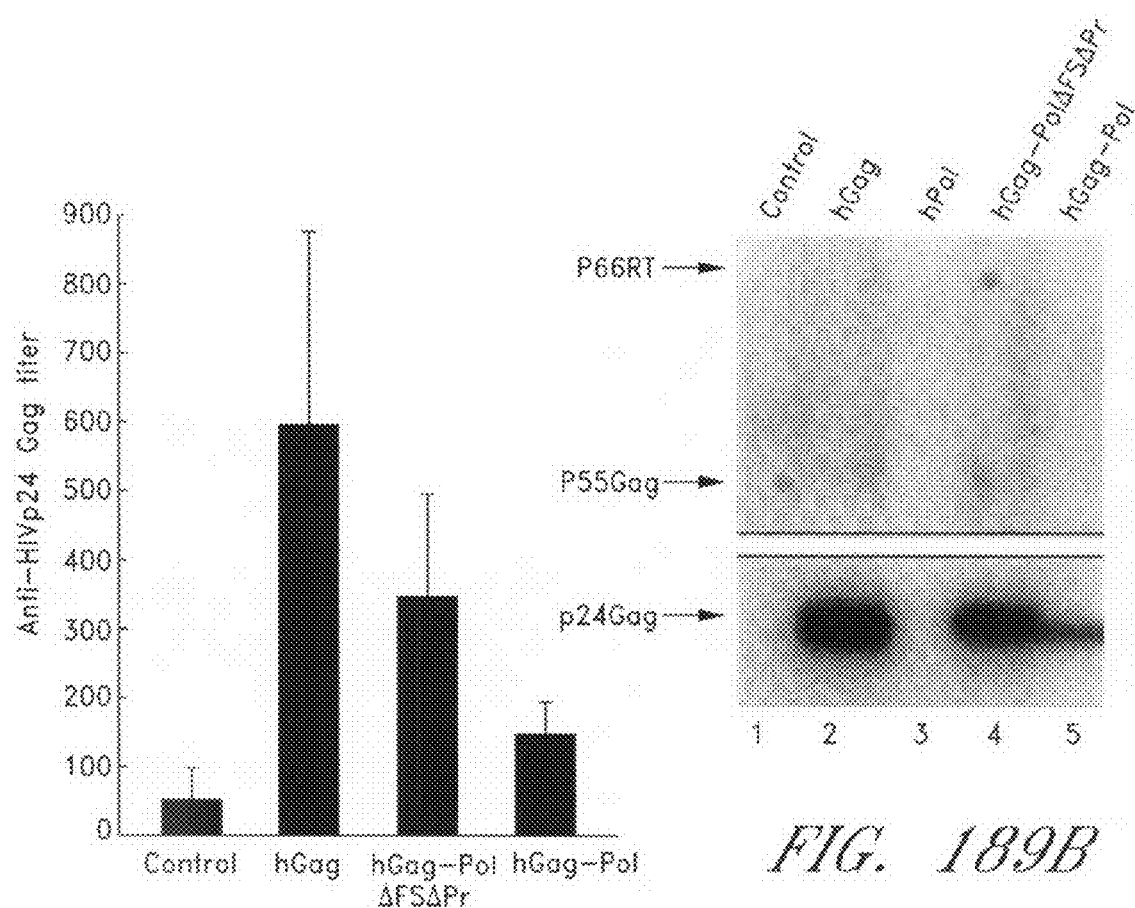
FIG. 189A
FIG. 189B
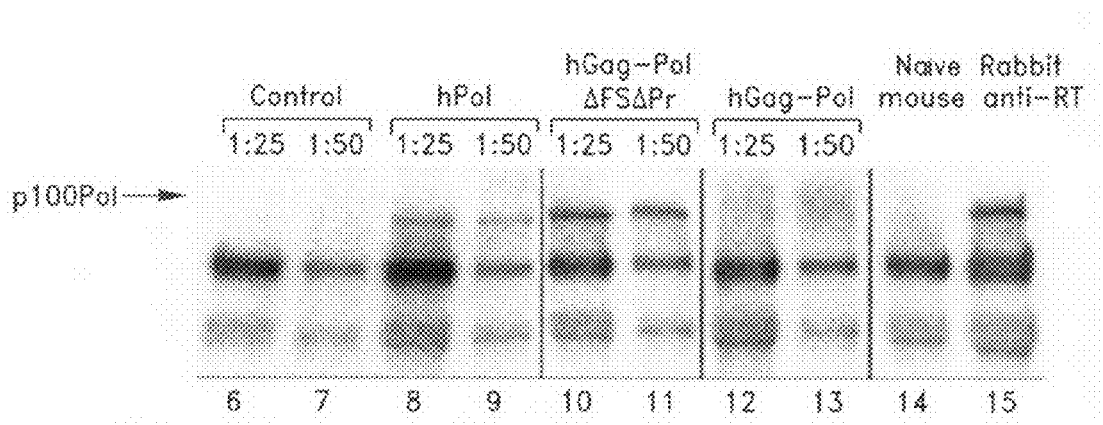
FIG. 189C

MODIFICATIONS OF HIV, ENV, GAG, AND POL ENHANCE IMMUNOGENICITY FOR GENETIC IMMUNIZATION

CROSS-REFERENCE TO RELATED APPLICATIONS

This application is a continuation of international application number PCT/US01/25721, and claims the benefit of priority of international application number PCT/US01/25721 having an international filing date of Aug. 14, 2001, designating the United States of America and published in English, which claims the benefit of priority of U.S. provisional patent application No. 60/279,257, filed Mar. 28, 2001, U.S. provisional patent application No. 60/252,115, filed Nov. 14, 2000, and U.S. provisional patent application No. 60/225,097, filed Aug. 14, 2000; all of which are hereby expressly incorporated by reference in their entireties.

FIELD OF THE INVENTION

The present invention relates to the field of molecular biology. The present invention discloses modified HIV Env, Gag, Pol, and Nef proteins, related nucleotide sequences, and usage for genetic immunization.

BACKGROUND OF THE INVENTION

Protective immunity against human immunodeficiency virus-1 (HIV-1) is likely to require recognition of linear and conformation epitopes from multiple HIV antigens. Whether these responses can be elicited more effectively by virion-like structures or fused CTL epitopes is unknown.

The immune response to HIV infection in long-term non-progressors and HIV-exposed sex workers suggests that specific viral immunity may limit infection and the symptoms of disease. No single characteristic yet correlates with protective immunity, but studies in non-human of primates suggest that both humoral and cellular immunity are required for this response. Depletion of cytotoxic T cells (CTLs) in chronically-infected macaques enhances viremia. In humans, higher CTL responses correlate with lower viral load and stabilization of clinical symptoms. In animal models, passive transfer of neutralizing antibodies can also contribute to protection against virus challenge. Neutralizing antibody responses can also be developed in HIV-infected individuals and are associated with lower viral loads in long-term non-progressors. Though this neutralizing antibody response is uncommon, it is directed largely against the Env protein of the virus.

In early human vaccine trials, gp120 protein immunogens have yielded disappointing results: vaccine-induced antibodies have not been broadly neutralizing and have sometimes enhanced infection in vitro. Monomeric gp120 loses oligomer-dependent epitopes and does not include sequences in the ectodomain of the gp41 that become exposed during virus entry. It is assumed that broadly neutralizing antibodies bind to native gp120/gp41 complex on the surface of the virus rather than soluble gp120.

The development of a cytotoxic T lymphocyte (CTL) response to viruses is often crucial to the outcome of infections. Lysis of infected cells prior to the production of progeny virions may limit virus burst size (Yang, O et al., 1996, J. Virol., 70: 5799-5806), and HIV specific $CD8^+$ cytotoxic T lymphocytes (CTL) have been shown to be important in viral clearance and in the control of initial HIV-1 spread (Borrow, P et al., 1994, J. Virol., 68: 6103-6110; Yang, O et al., 1996, J. Virol. 70: 5799-5806). CTL responses specific to HIV also contribute to reduction in viral load during acute and asymptomatic infection (Klein, M R, et al., 1995, J. Exp. Med. 181: 1365-1372; Moss, P A H et al., 1995, Proc. Natl. Acad. Sci. USA, 92: 5773-5777) and may be involved in protection against the establishment of persistent HIV infections (Rowland-Jones, S L et al., 1993, Lancet, 341: 860-861; Rowland-Jones, S L et. al., 1995, Nat. Med., 1: 59-64). High-frequency CTL responses to HIV-1 correlated with low viral load and slow disease progression in chronically infected individuals (Musey, L et al., 1997, N. Engl. J. Med., 337: 1267-1274; Ogg, G S et al., 1998, Science, 279: 2103-2106.). More compelling evidence of an antiviral effect of $CD8^+$ cells was demonstrated in controlled studies in macaques, in which $CD8^+$ cells were depleted in vivo using a monoclonal antibody. The viral loads in these animals increased or decreased as the $CD8^+$ cells were depleted or reappeared, respectively (Jin, X et al., 1999, J. Exp. Med., 189: 991-998; Schmitz, J E, et al., 1999, Science, 283: 857-860). Therefore, induction of a CTL response specific to these proteins represents a desirable response in an HIV-1 vaccine.

HIV-1 internal structural and enzymatic proteins contain conserved domains that preserve their functions and thus exhibit less antigenic diversity that may elicit more effective CTL responses (Nixon, D F et al., 1988, Nature, 336: 484-487.). Efficient and durable CTL responses require endogenous antigen synthesis and processing. Current vaccine delivery techniques include immunization with live, attenuated viruses, inactivated recombinant virus infection (Letvin, N L, 1998, Science, 280: 1875-1880) or plasmid DNA expression vectors. A major obstacle in the induction of CTL responses with naked DNA or recombinant virus during development of an HIV vaccine is that the expression of HIV-1 structural and enzymatic genes is tightly regulated by the virus itself. The expression of these proteins is heavily dependent upon the existence of the Rev-responsive element (RRE) of HIV-1 in recombinant vectors (Cullen, B R, 1992, Microbiol. Rev., 56: 375-394; Felber, B K et al., 1989, Proc Natl Acad Sci USA, 86: 1495-1499). Poor expression is caused by the presence of AT rich inhibitory nucleotide sequences (INS) in the gag, pol and env genes, which inhibit the nuclear export and efficient expression of unspliced HIVI mRNAs. Early studies of DNA vaccination against HIV in mice required the inclusion of Rev in their expression vectors (Lu, S et al., 1995, Virology, 209: 147-154; Okuda, K et al., 1995, AIDS Res. Hum. Retroviruses, 11: 933-943; Wang, B et al., 1993, Proc. Natl. Acad. Sci. U.S. A 90: 4156-4160), but modification of INS has been shown to facilitate Rev-independent expression of HIV-1 Gag (Qiu, J-T et al., 1999, J. Virol., 73: 9145-9152; zur Megede, J et al., 2000, J Virol 74: 2628-2635), allowing detectable humoral and CTL responses against this protein (Qiu, J-T et al., 1999, J. Virol., 73: 9145-9152). These modified HIV-1 Gag genes produced viral-like particles of the expected density and morphology and induced an immune response to HIV-1 Gag after DNA immunization in mice (zur Megede, J et al., 2000, J Virol, 74: 2628-2635).

SUMMARY OF THE INVENTION

Protective immunity against human immunodeficiency virus-1 (HIV-1) is likely to require recognition of linear and conformation epitopes from multiple HIV antigens, and whether these responses can be elicited more effectively by virion-like structures or fused CTL epitopes was previously unknown. Herein is provided a modified HIV Env with deletions in the cleavage site, fusogenic domain, and spacing of heptad repeats 1 and 2 to expose the core protein for optimal antigen presentation and recognition. Additionally we provide a Gag-Pol or Gag-Pol-Nef fusion protein that is a polyprotein designed to maximize epitope presentation. The invention extends the mutation in HIV Env, Gag, Pol, and Nef to any HIV clade or strain and to related proteins of other viruses. Different combinations, different orders, and different variations on a theme are envisioned, the theme being to optimize presentation of epitopes that generate broad CTL and antibody responses.

More particularly, we have investigated the effect of specific mutations in human immunodeficiency virus type 1 (HIV-1) envelope (Env) on humoral and cellular immune responses after DNA vaccination. Mice were injected with plasmid expression vectors encoding HIV Env with modifications of conserved glycosylation sites or different COOH-terminal mutations intended to mimic a fusion intermediate. Elimination of conserved glycosylation sites did not substantially enhance humoral or CTL immunity. In contrast, a modified gp140 with deletions in the cleavage site, fusogenic domain and spacing of heptad repeats 1 and 2 enhanced humoral immunity without reducing the efficacy of the CTL response. Because of its ability to stimulate the antibody response to native gp160 without affecting cellular immunity, this modified gp140 or a related derivative is envisioned to be a useful component of an AIDS vaccine.

In addition, we have examined the immune response to HIV-1 Gag and Pol after plasmid DNA immunization with Rev-independent expression vectors encoding various forms of these proteins. Immune responses were analyzed after vaccination with four expression vectors, including Gag alone or Gag-Pol, both of which gave rise to virion-like particles (VLPs), compared to Pol alone or a Gag-Pol fusion protein that did not form VLPs. The Gag-Pol fusion protein induced the most broad and potent CTL responses to Gag and Pol in DNA-vaccinated mice, and this immunogen also readily elicited an antibody response to HIV-1 Gag and Pol determinants. Through its ability to induce broad CTL and antibody responses, this Gag-Pol fusion protein or a related derivative is envisioned to be a useful component of an AIDS vaccine.

The patent or application file contains at least one drawing executed in color. Copies of this patent or patent application publication with color drawings will be provided by the Office upon request and payment of the necessary fee.

BRIEF DESCRIPTION OF THE DRAWINGS

The patent or application file contains at least one drawing executed in color. Copies of this patent or patent application publication with color drawings will be provided by the Office upon request and payment of the necessary fee.

FIG. 1. Plasmid 2100.

FIG. 158. Plasmid 3901.
FIG. 176. Plasmid 4313.

FIG. 177. Comparison of GP2 with the structures of viral and cellular on proteins. (A) Recombinant Ebola Zaire GP2, (B) Recombinant Mo-55 from the TM subunit of MoMuLv, (C) Low pH-treated HA2 from influenza virus, (D) Recombinant, proteolysis-resistant core of HIV-1 gp41, (E) Recombinant SIV gp41, NMR structure, (F) Recombinant core coiled segments of the SNARES syntaxin 1-A, synaptobrevin-II, and SNAP-25B. Weissenhorn et al., 1998, Molecular Cell, 2, 605-616.

FIG. 185. HIV-1 Gag-Pol expression in transfected 293T cells and stably transfected CT26 and BC10 ME cells. Cell lysates from 293T cells transfected with pCMV ΔR8.2 containing viral Gag-Pol (vGag-Pol), pNGVL-hGag, hPol, hGag-PolΔFSΔPr and hGag-Pol were separated by 4-15% gradient SDS-PAGE, transferred to nitrocellulose filters, an analyzed by immunoblotting with (A) human anti HIV-1-IgG, (B) monoclonal anti-24, and (C) rabbit anti-RT. (D) Cell lysates from CT26 and BC10ME cells stably transduced with either hGag or hPol were analyzed with human anti HIV-1-IgG.

FIG. 189. HIV-1 p24 antibody ELISA assays, HIV-1 immunoblotting and immunoprecipitation Western blotting. (A) An HIV-1 p24 antibody ELISA assay was performed by coating 96-well plates with 50 µl of purified recombinant HIV-1$_{III}$B p24 antigen at a concentration of 2 µg/ml in PBS buffer, pH 7.4. (B) HIV-1 immunoblotting of strips containing HIV-1 proteins were incubated with pooled mouse sera at a dilution of 1:25. Bands were visualized using the ECL western blotting detection reagent. (C) Immunoprecipitation and Western blotting of hPol gene-transfected 293T cell lysates three days after transfection with RIPA buffer. The pooled mouse serum was diluted with IP buffer. After adding 10 µg of the cell lysate containing HIV-1 Pol protein, the reactions were incubated overnight on a rotator at 4° C. The next day, 250 µl of Protein G and A Sepharose beads (10% V/V in IP buffer) were added, and the reactions were incubated on a rotator for 2 hours at 4° C. The reactions were washed 4× with IP buffer, re-suspended with 30 μl of 1× sample buffer, and then loaded onto SDS-PAGE. The reactions were transferred to an Immobilon P membrane, and then incubated with anti HIV-1-IgG. Bands were visualized using the ECL Western blotting detection reagent.

TABLE 1

Figure 1:
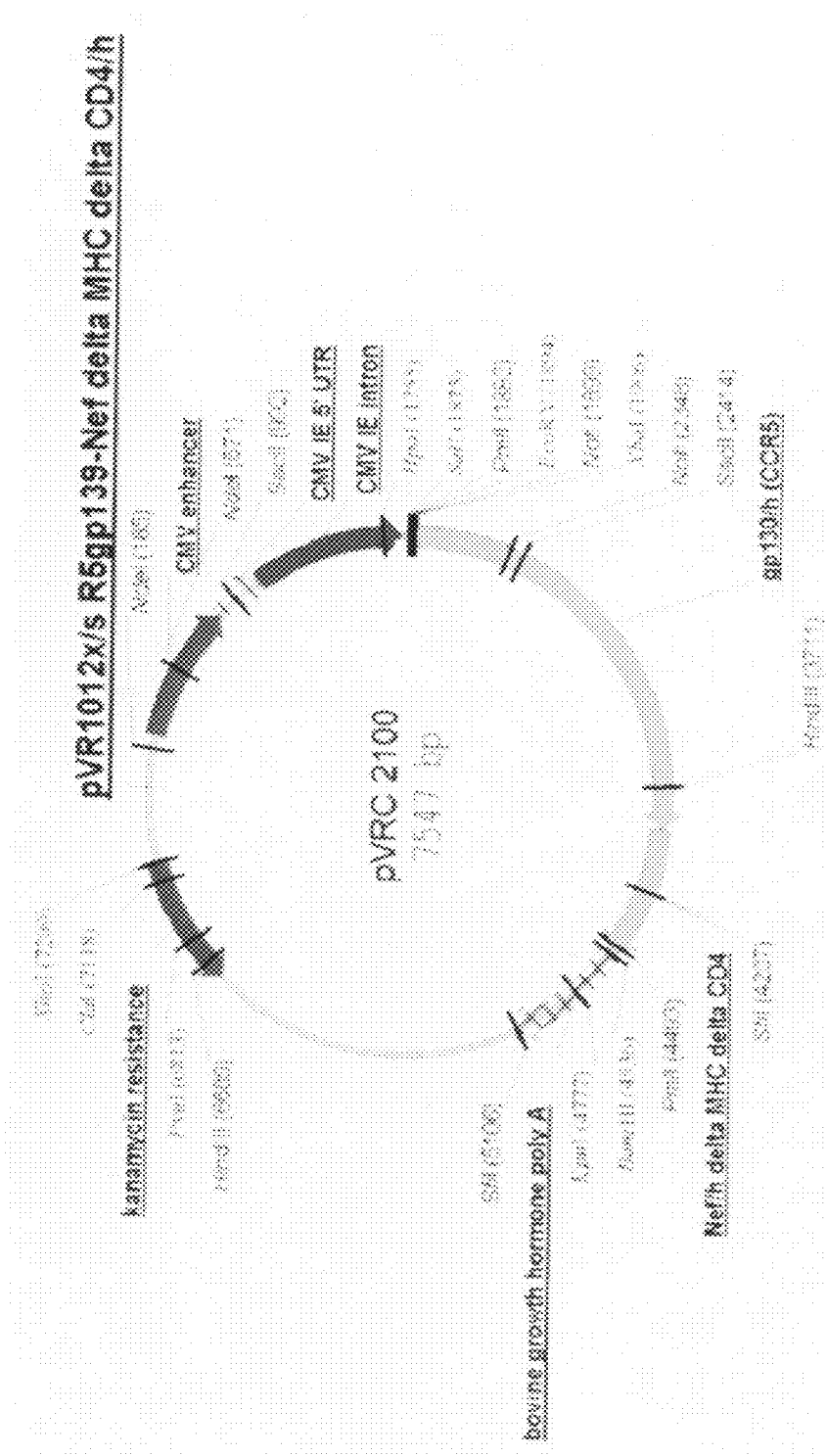
FIGS. 1-176. Plasmid Maps. Table 1 provides the description of each of which illustrates a map of a plasmid described herein.
Figure 2:
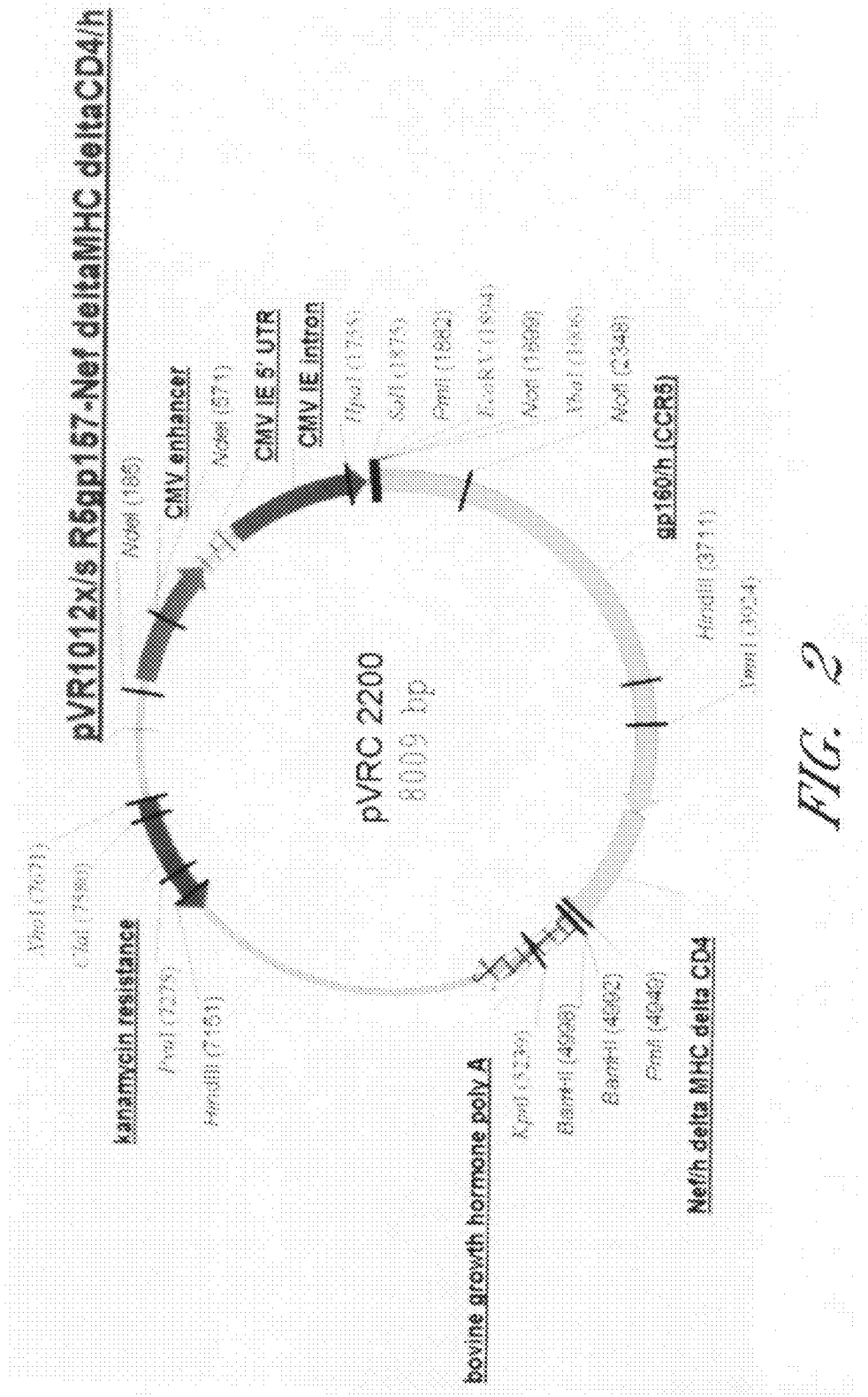
FIG. 2. Plasmid 2200.
Figure 3:
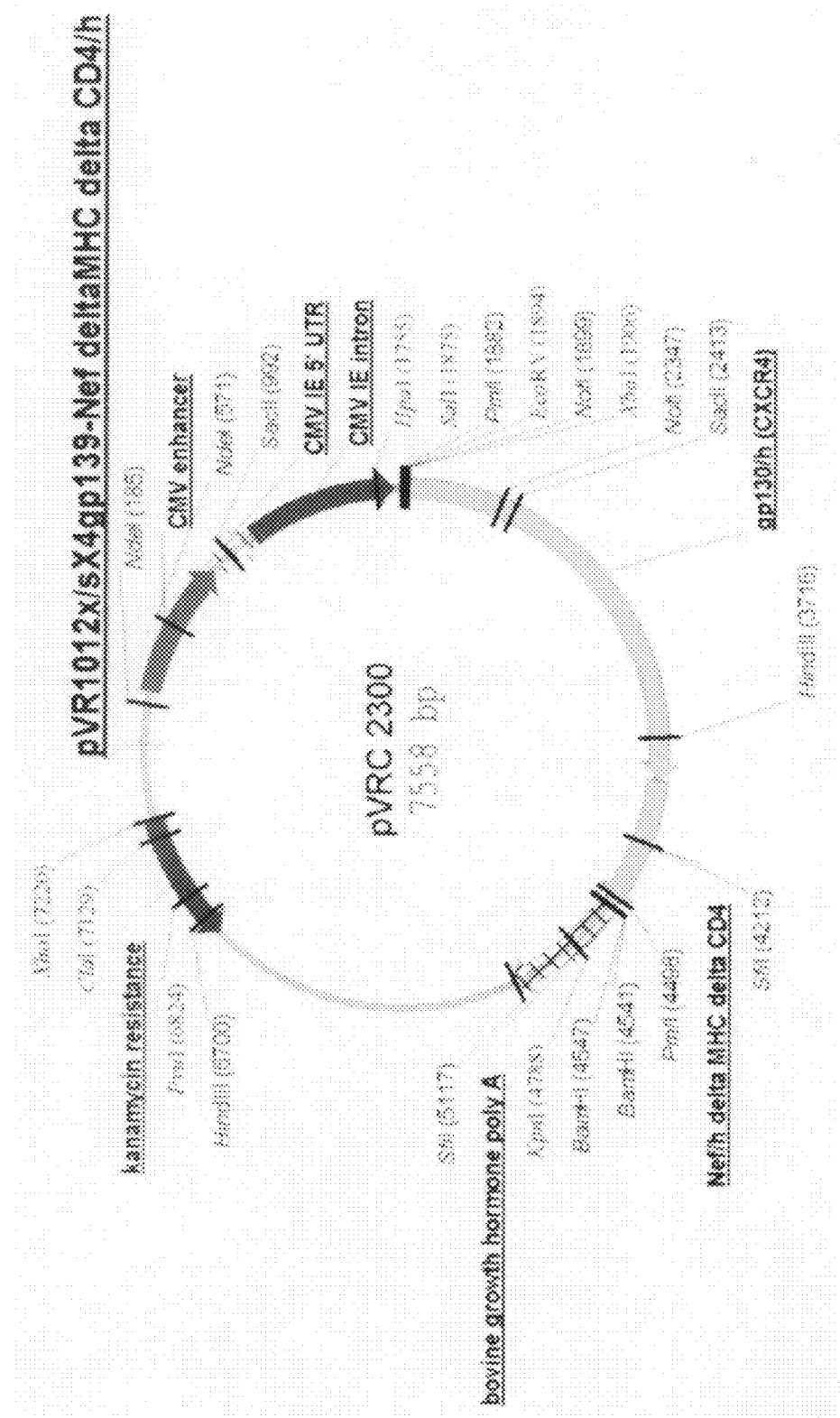
FIG. 3. Plasmid 2300.
Figure 4:
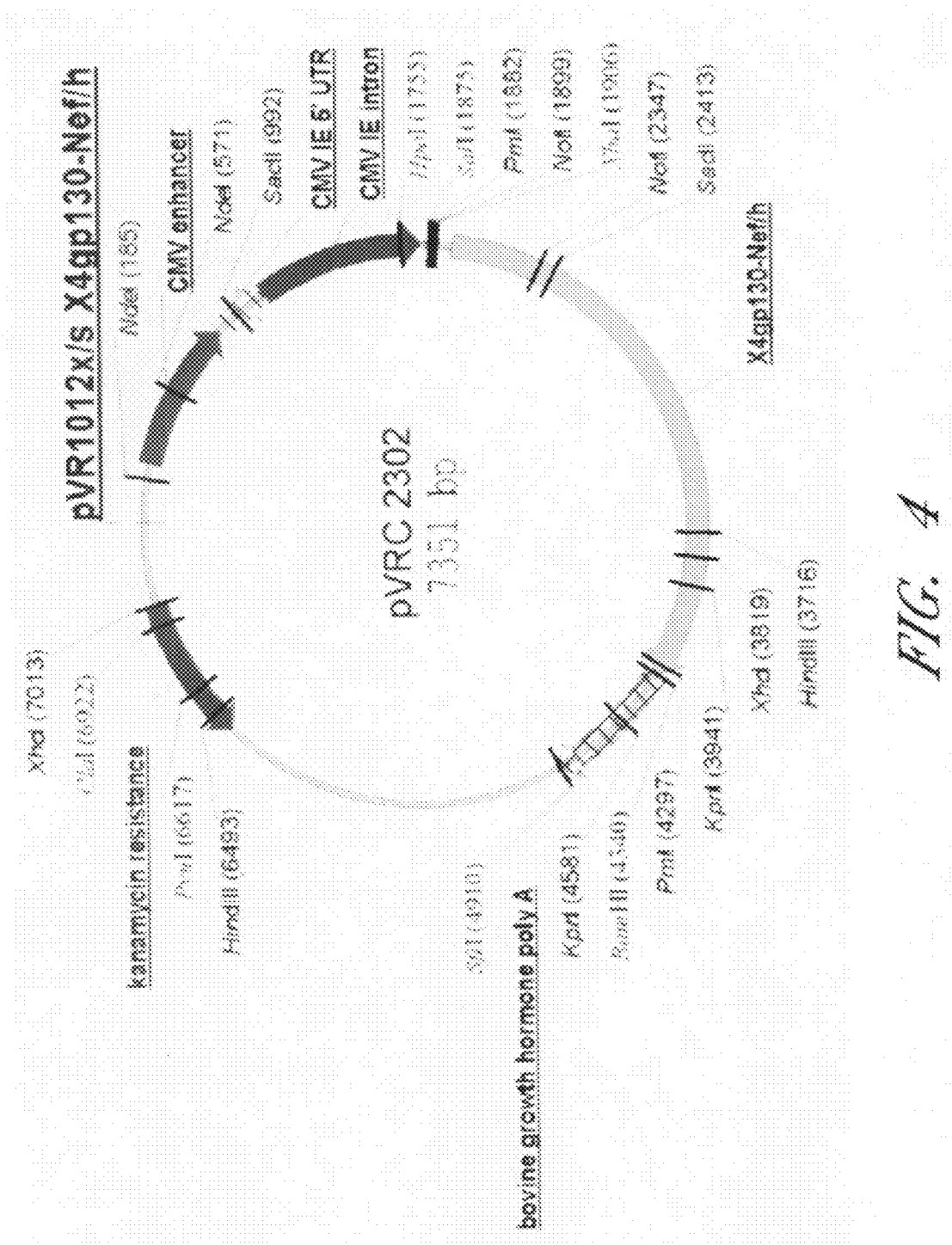
FIG. 4. Plasmid 2302.
Figure 5:
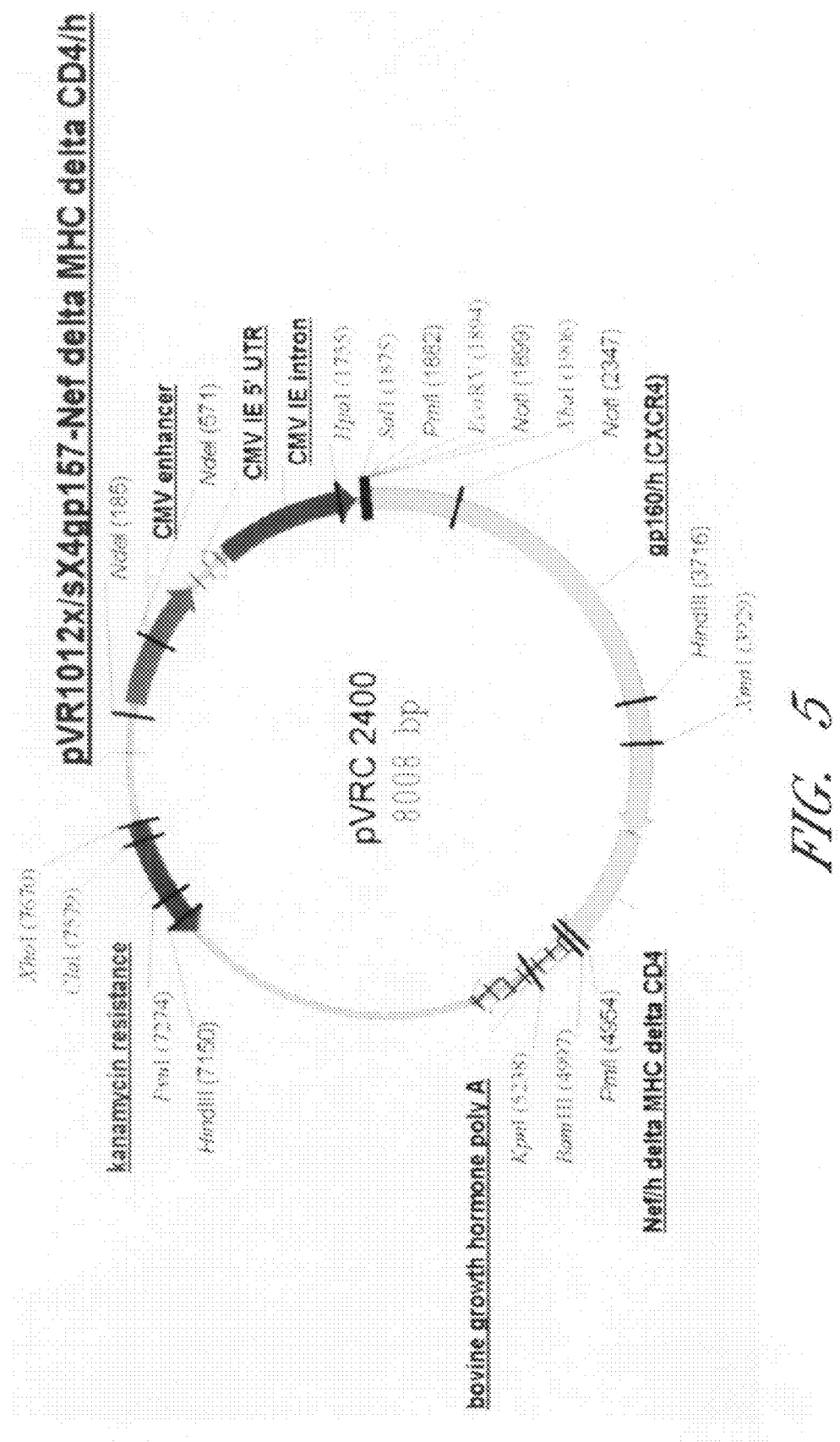
FIG. 5. Plasmid 2400.
Figure 6:
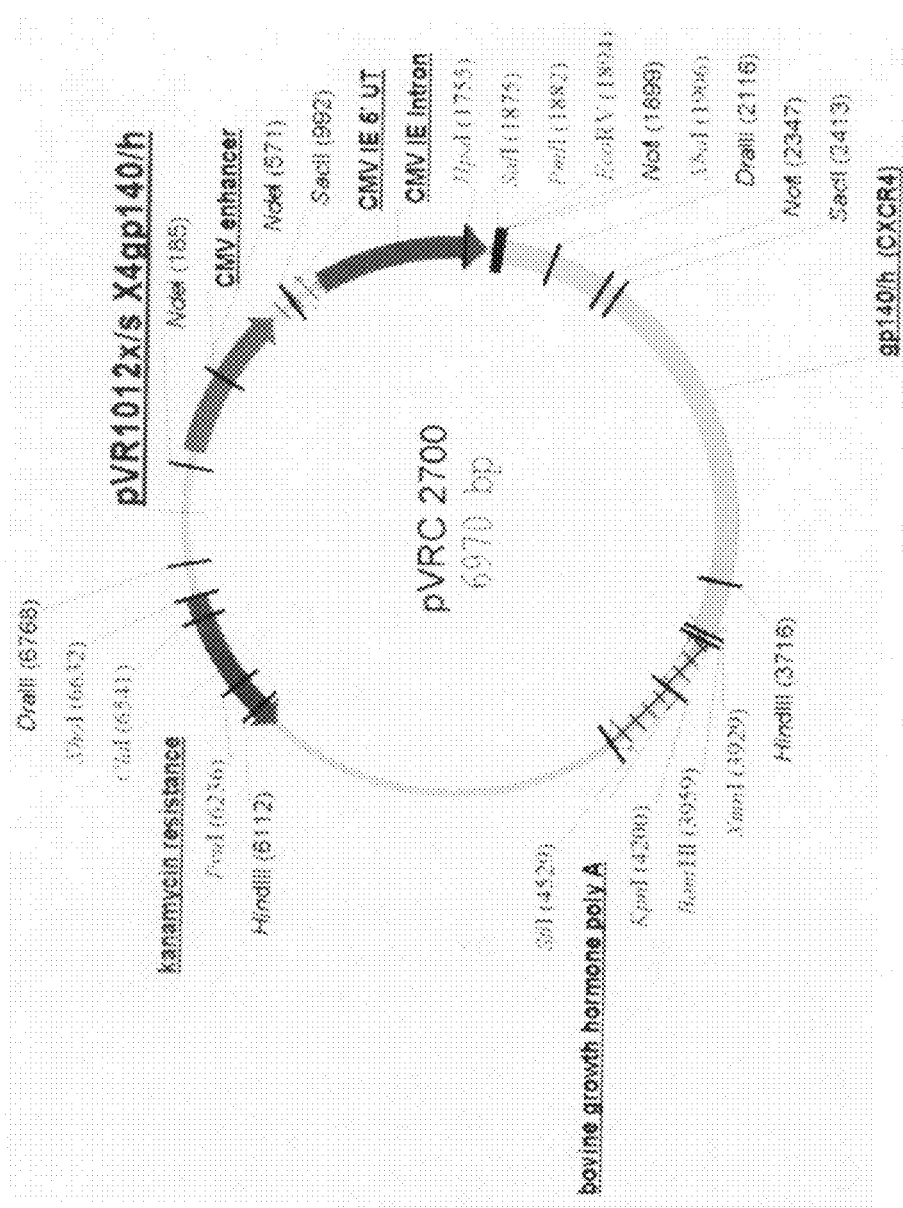
FIG. 6. Plasmid 2700.
Figure 7:
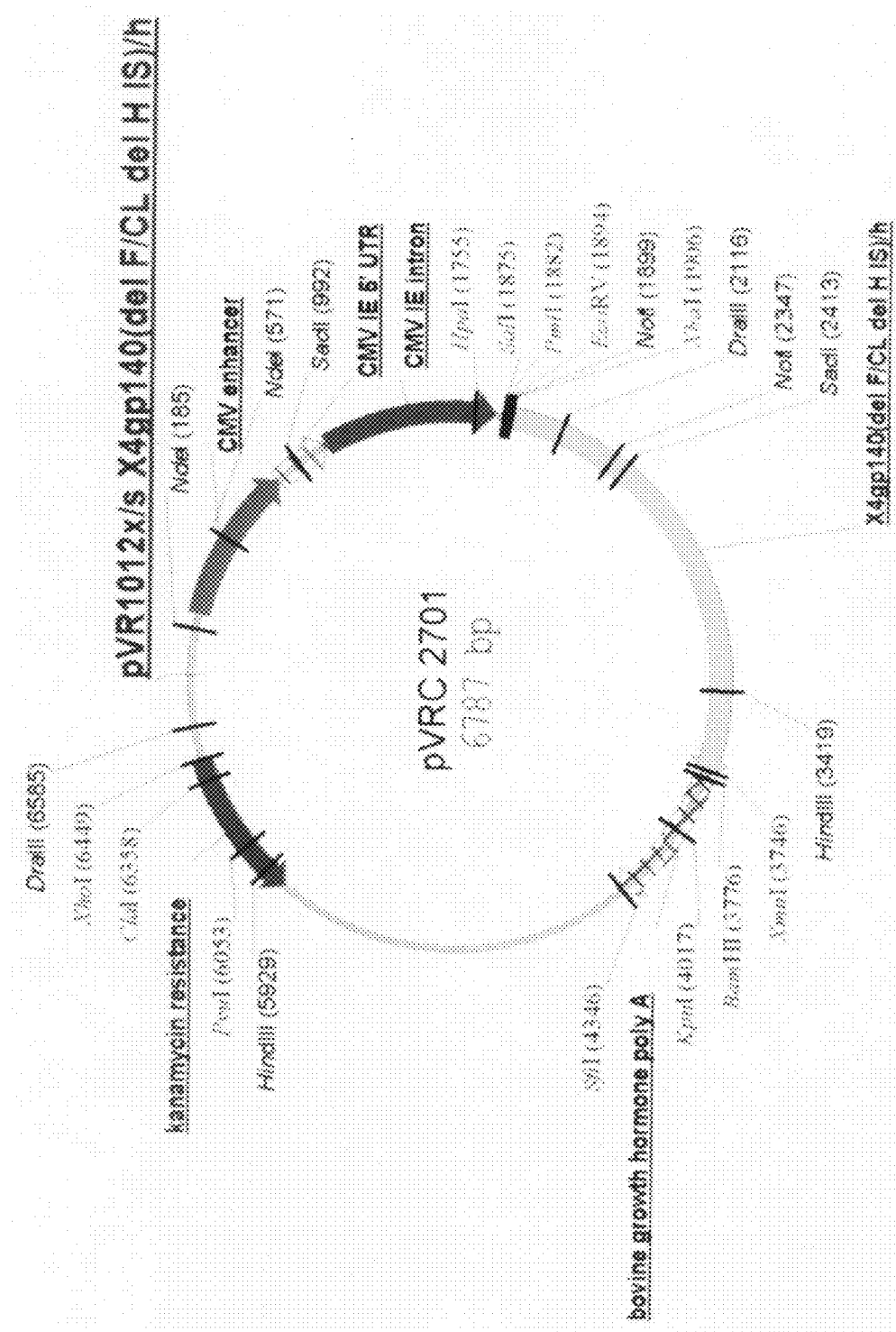
FIG. 7. Plasmid 2701.
Figure 8:
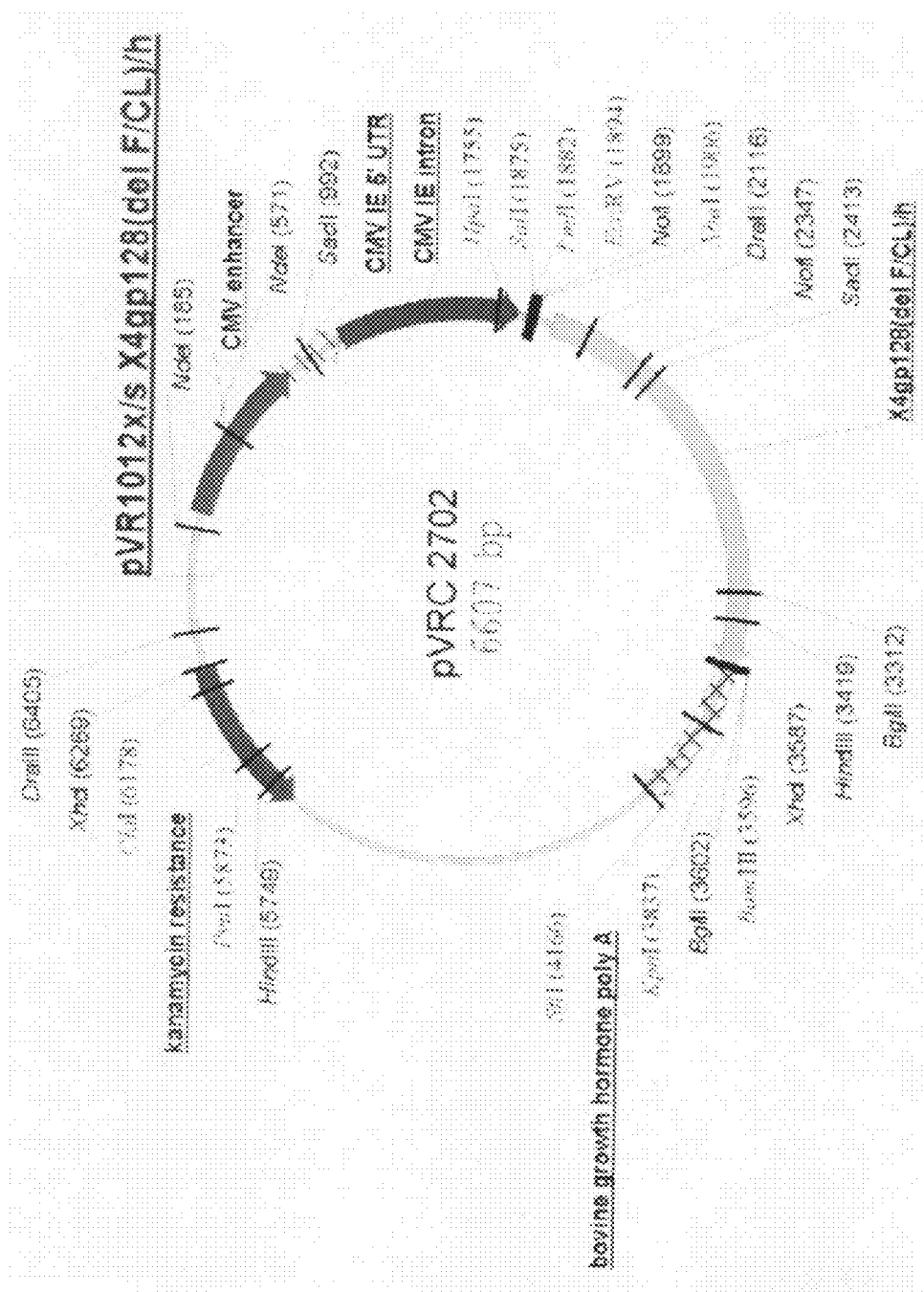
FIG. 8. Plasmid 2702.
Figure 9:
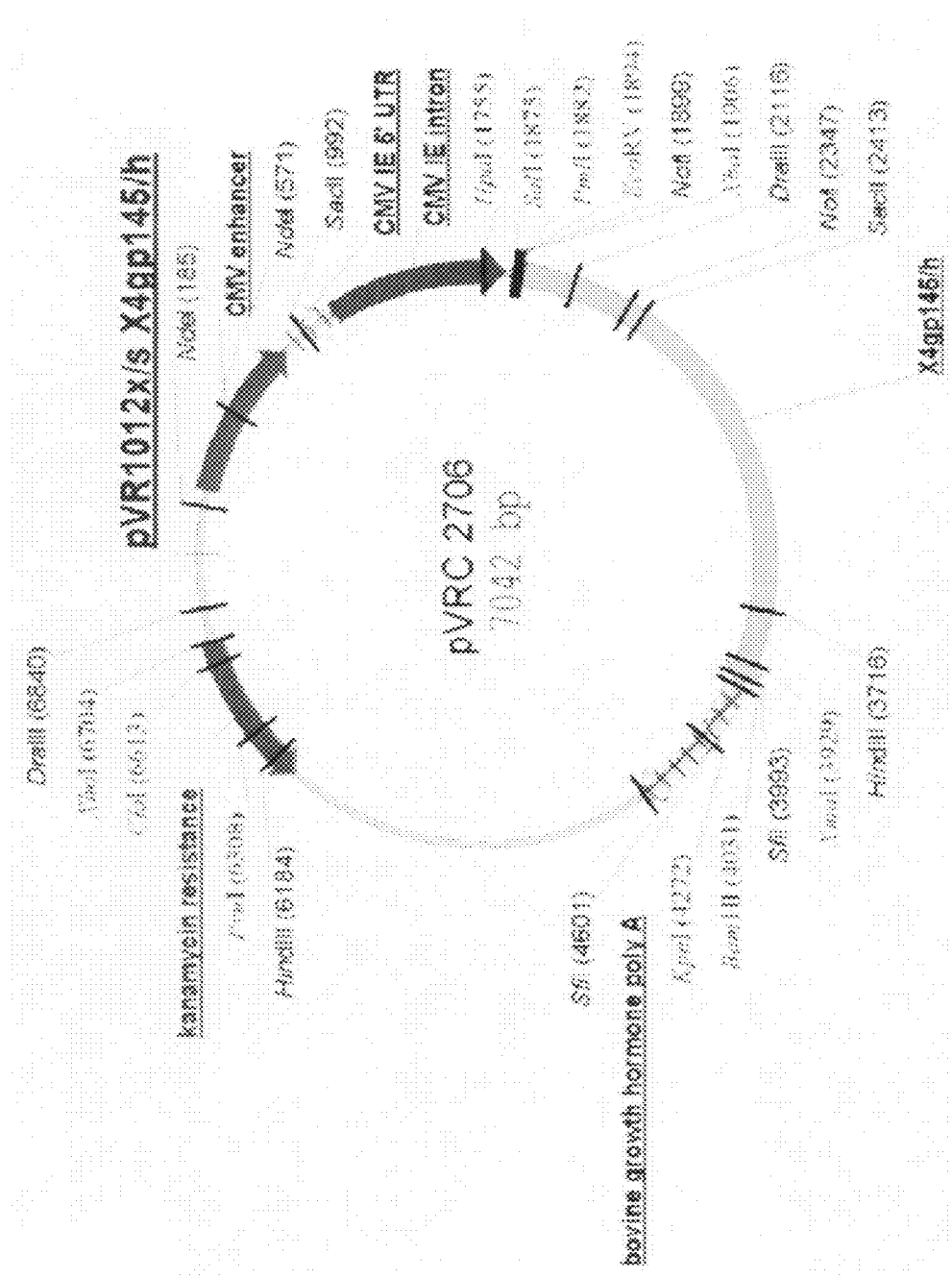
FIG. 9. Plasmid 2706.
Figure 10:
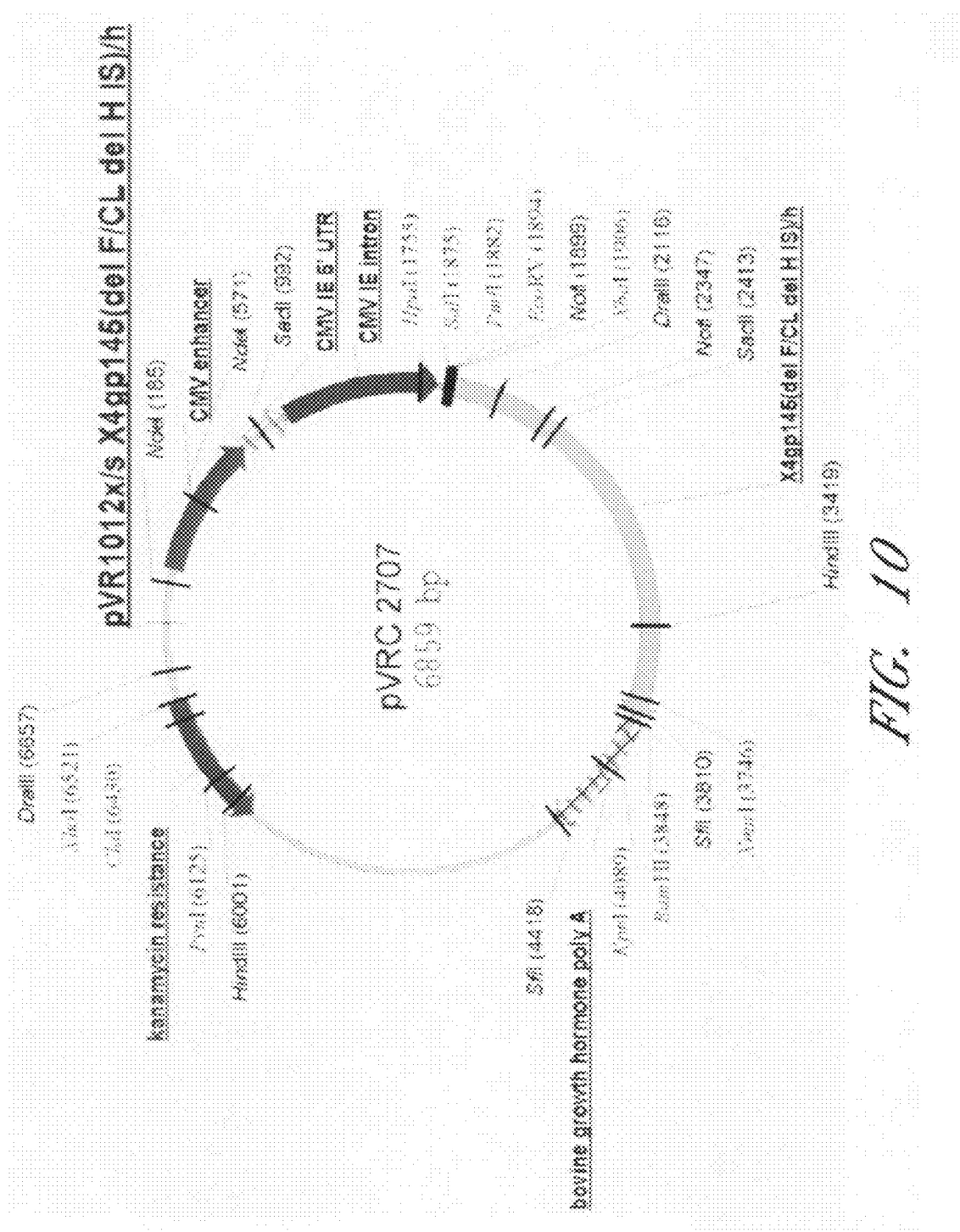
FIG. 10. Plasmid 2707.
Figure 11:
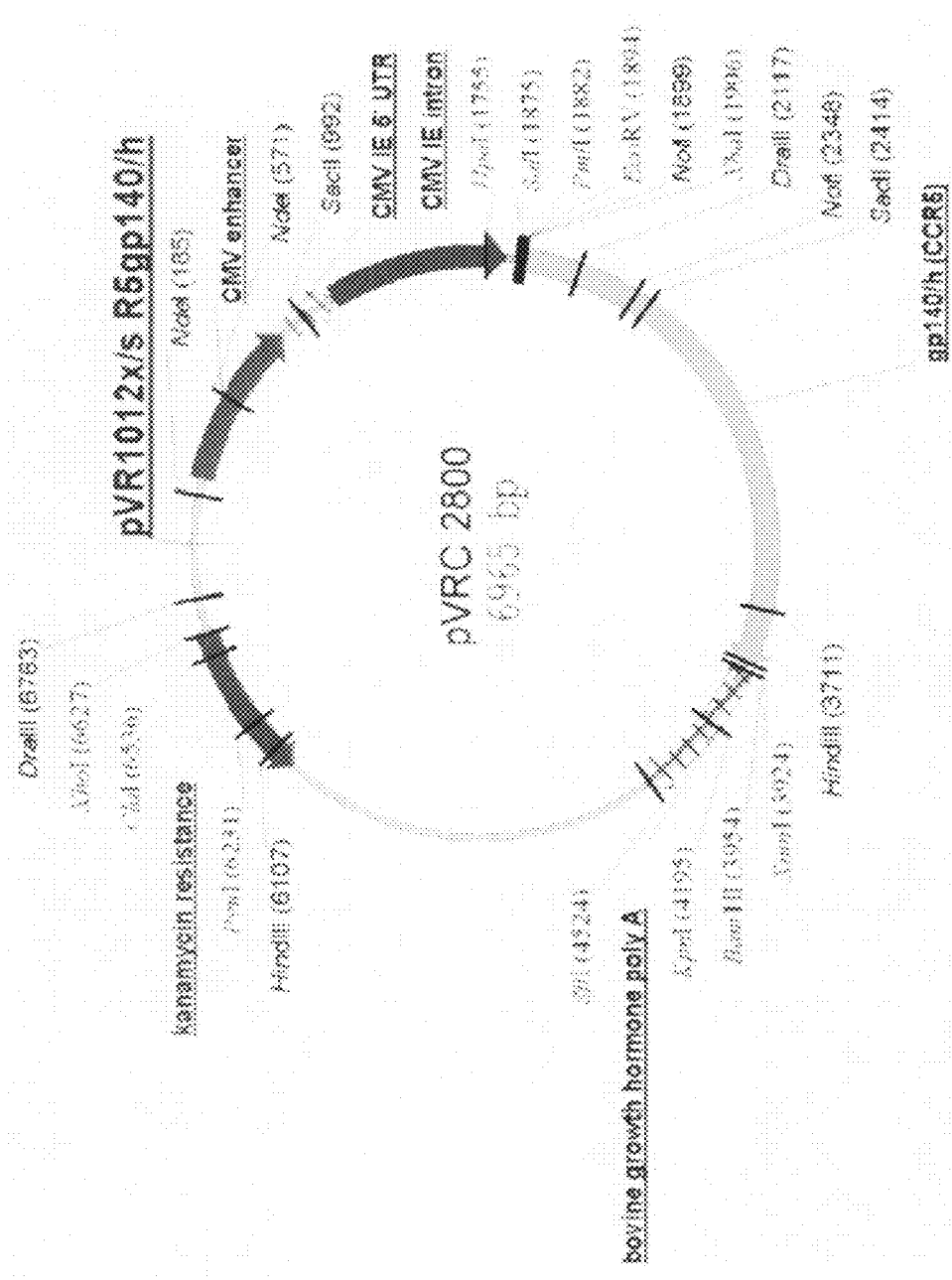
FIG. 11. Plasmid 2800.
Figure 12:
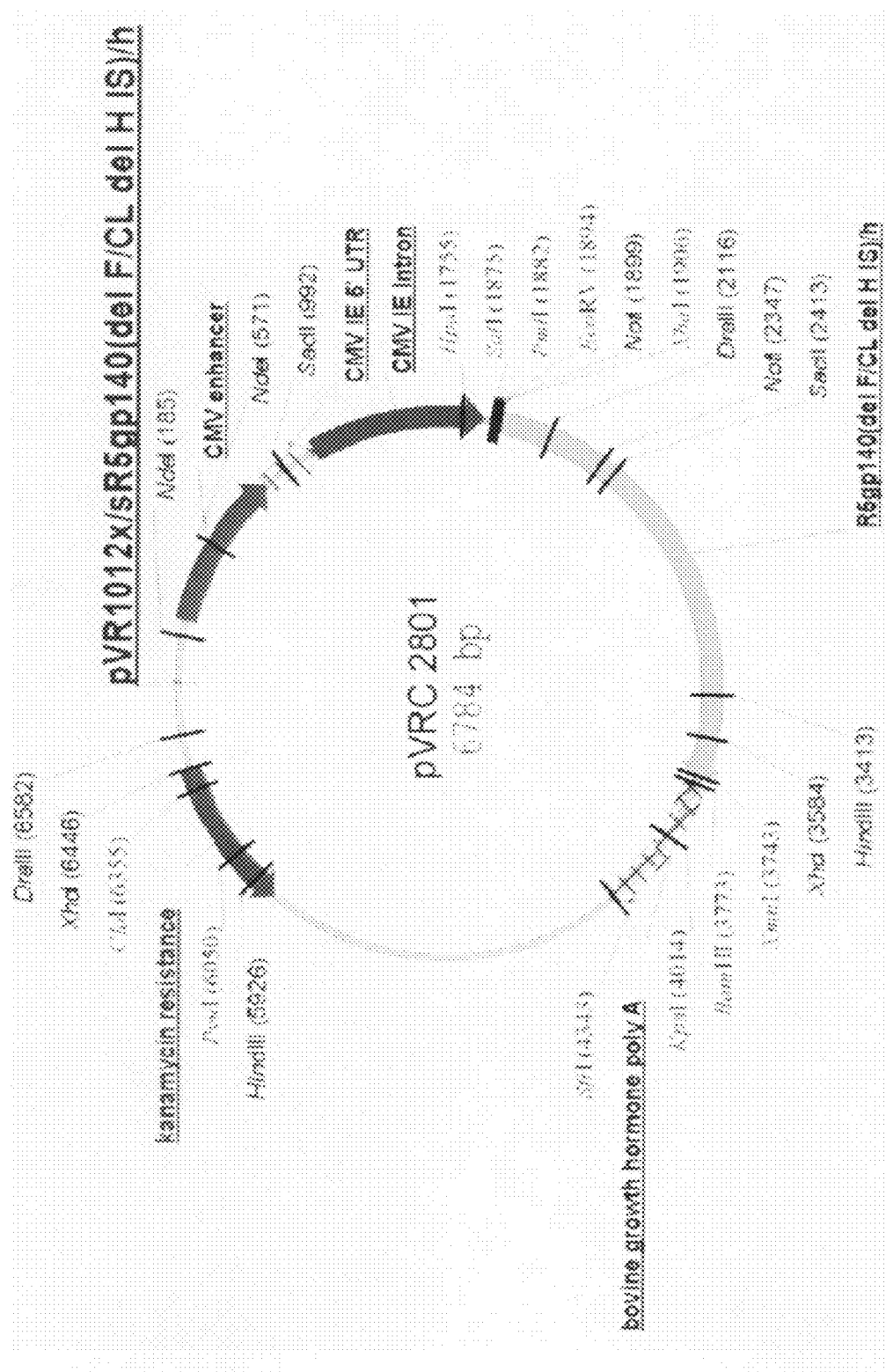
FIG. 12. Plasmid 2801.
Figure 13:
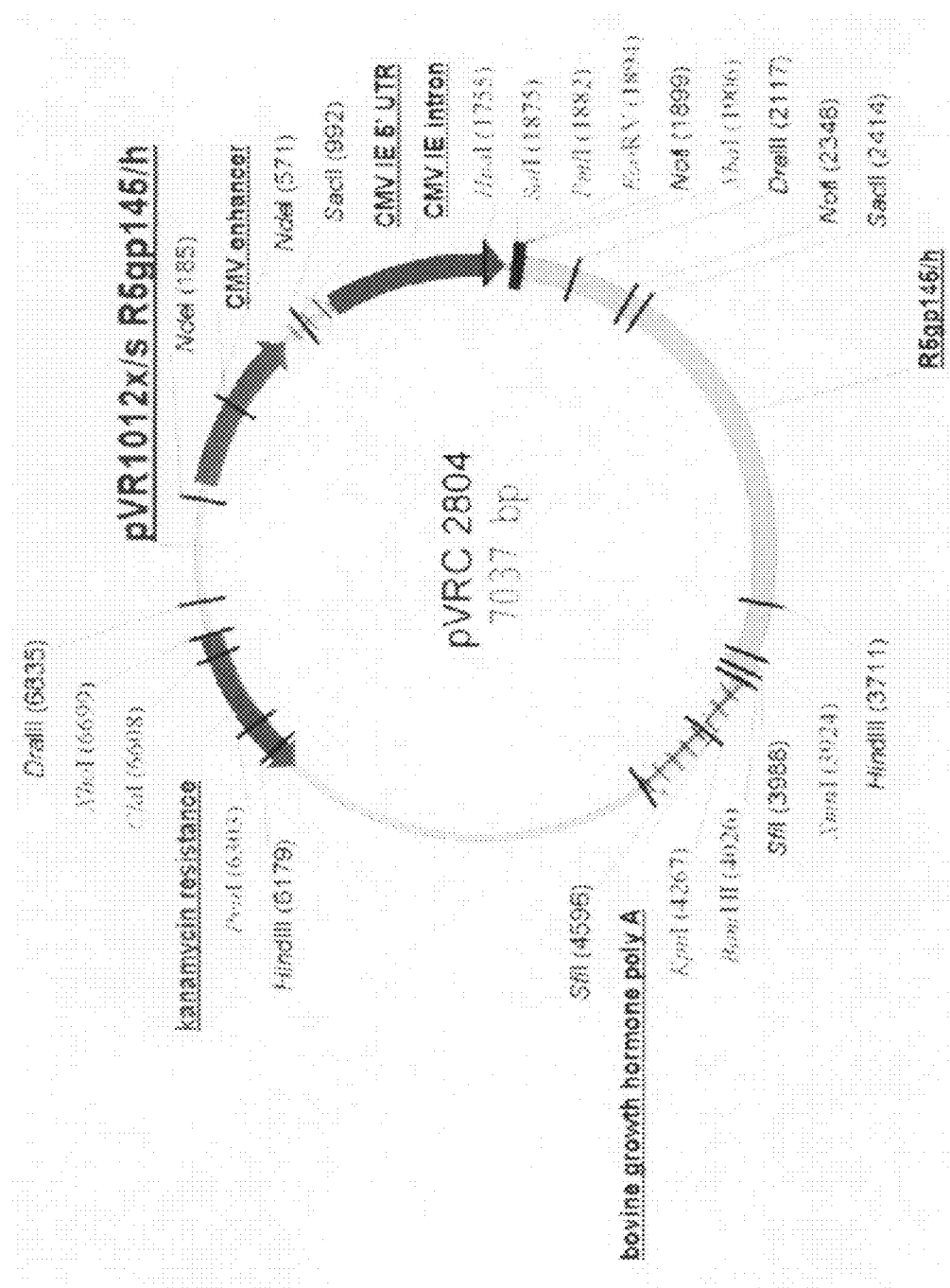
FIG. 13. Plasmid 2804.
Figure 14:
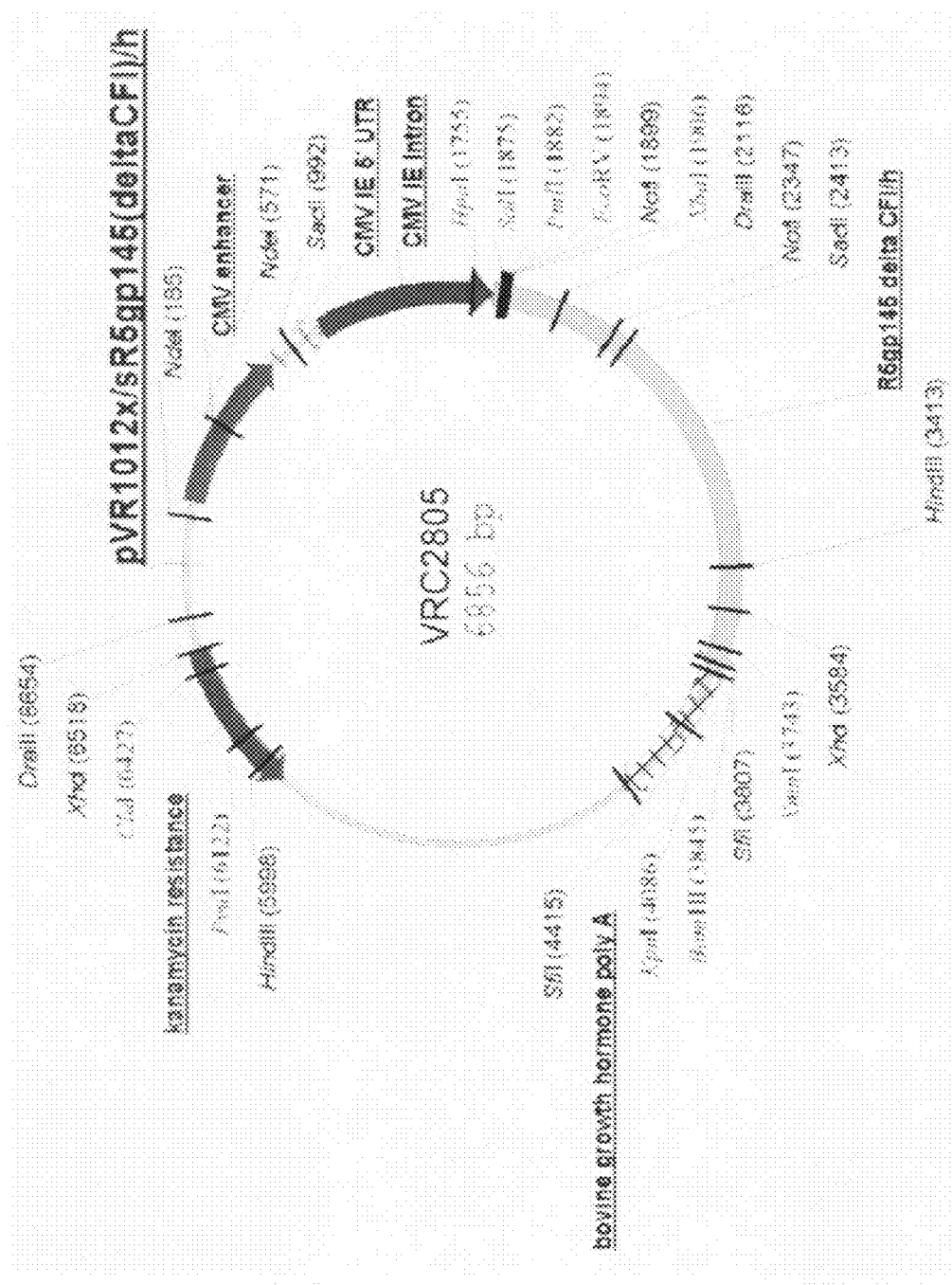
FIG. 14. Plasmid 2805.
Figure 15:
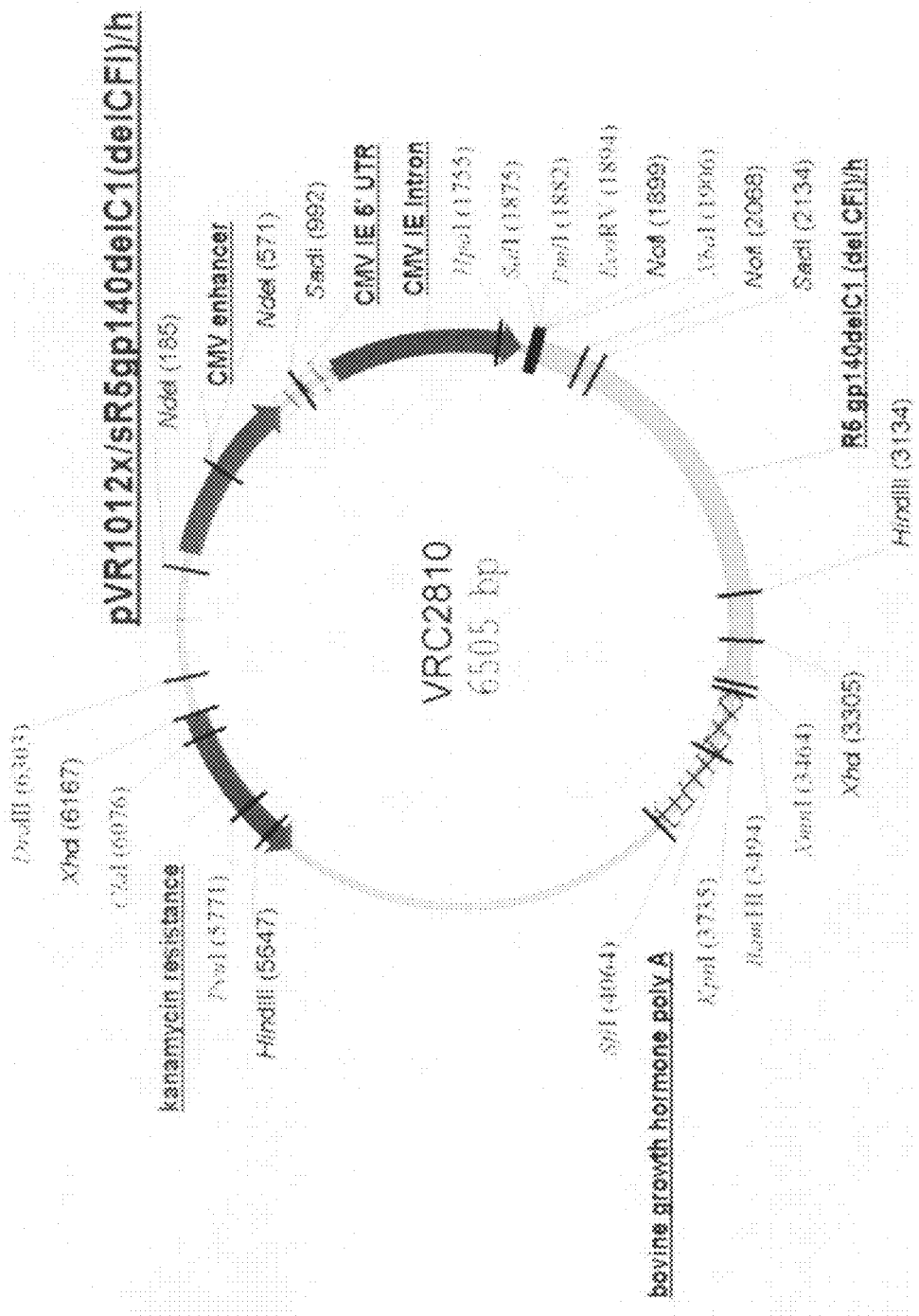
FIG. 15. Plasmid 2810.
Figure 16:
FIG. 16. Plasmid 2811.
Figure 17:
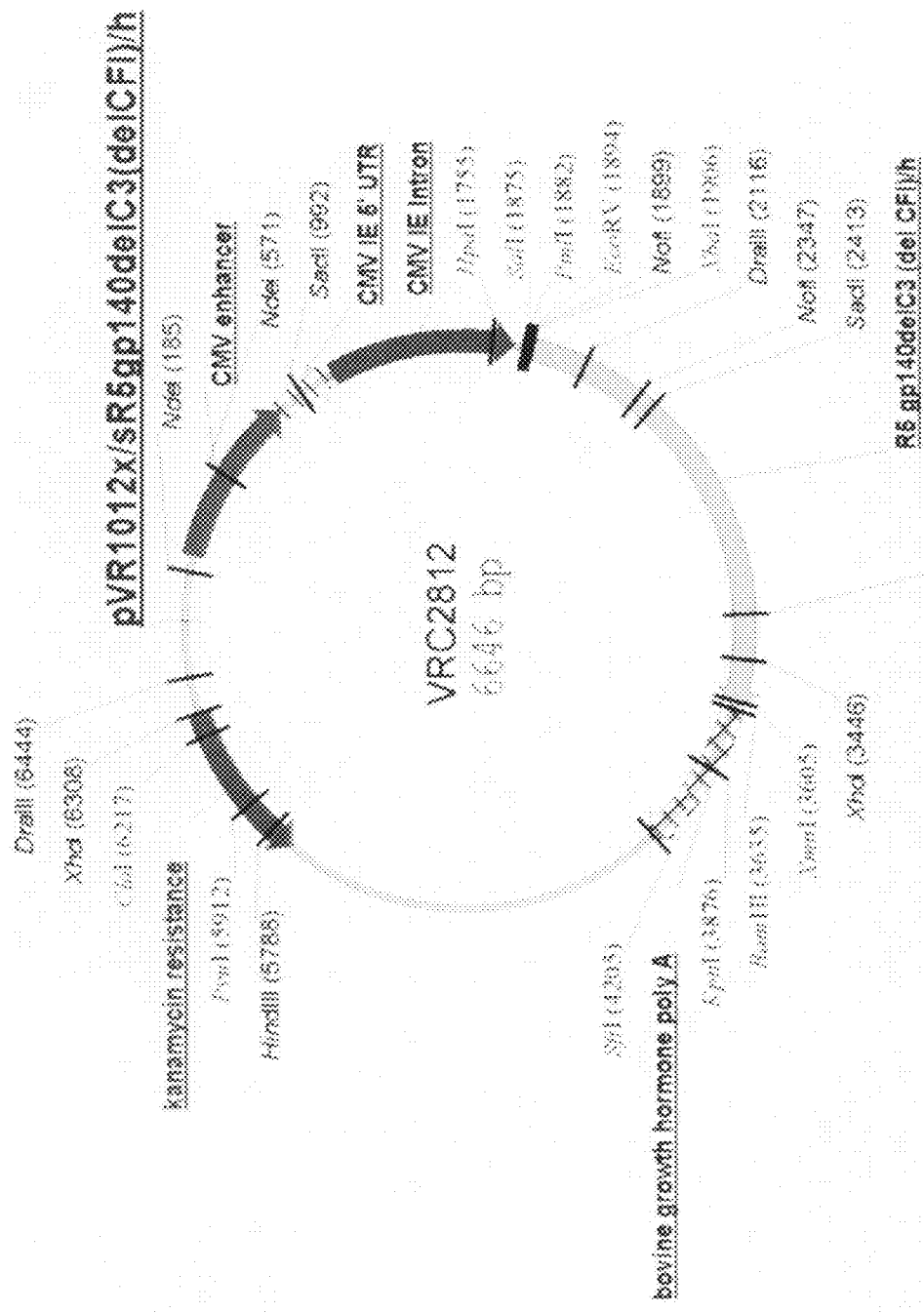
FIG. 17. Plasmid 2812.
Figure 18:
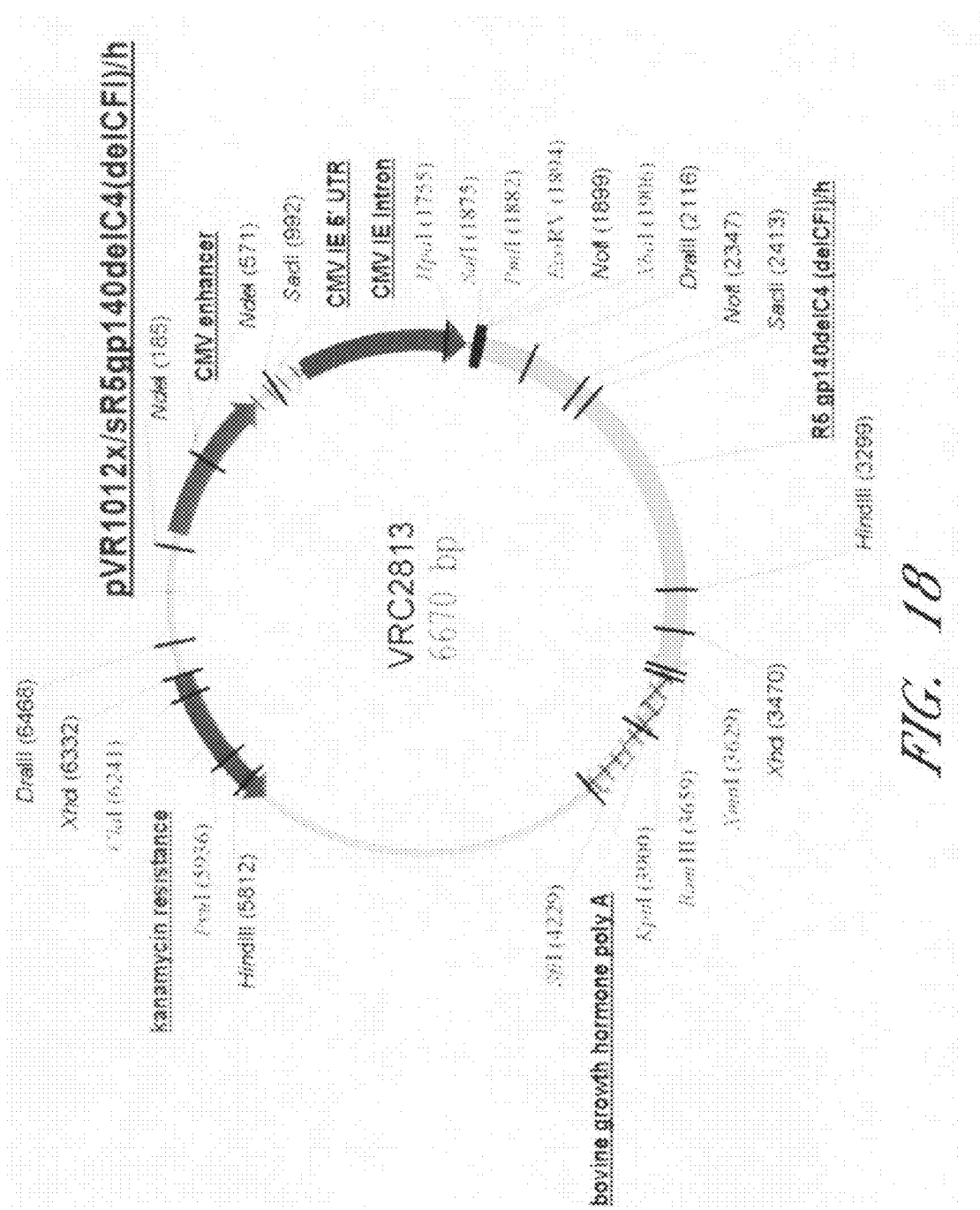
FIG. 18. Plasmid 2813.
Figure 19:
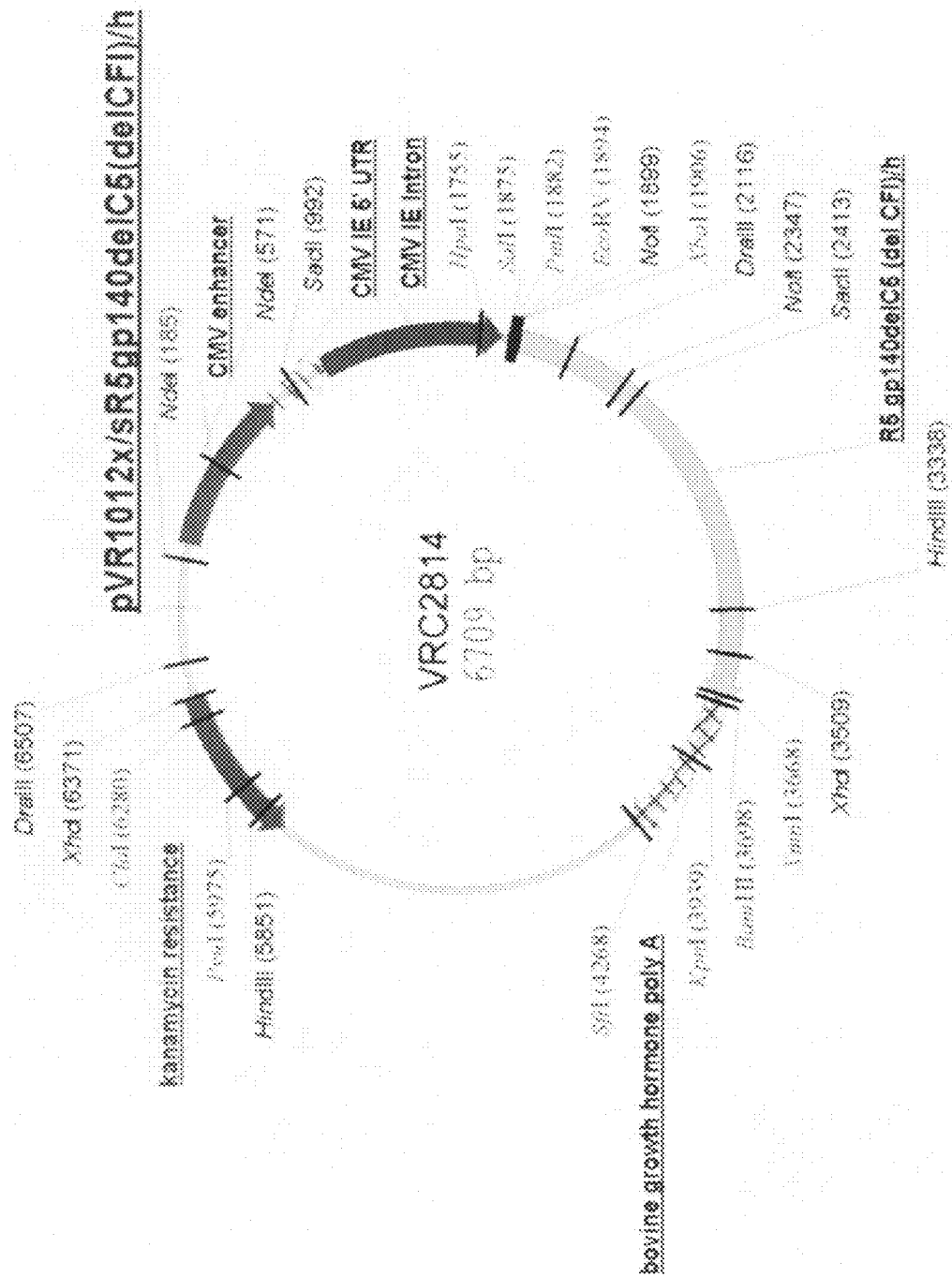
FIG. 19. Plasmid 2814.
Figure 20:
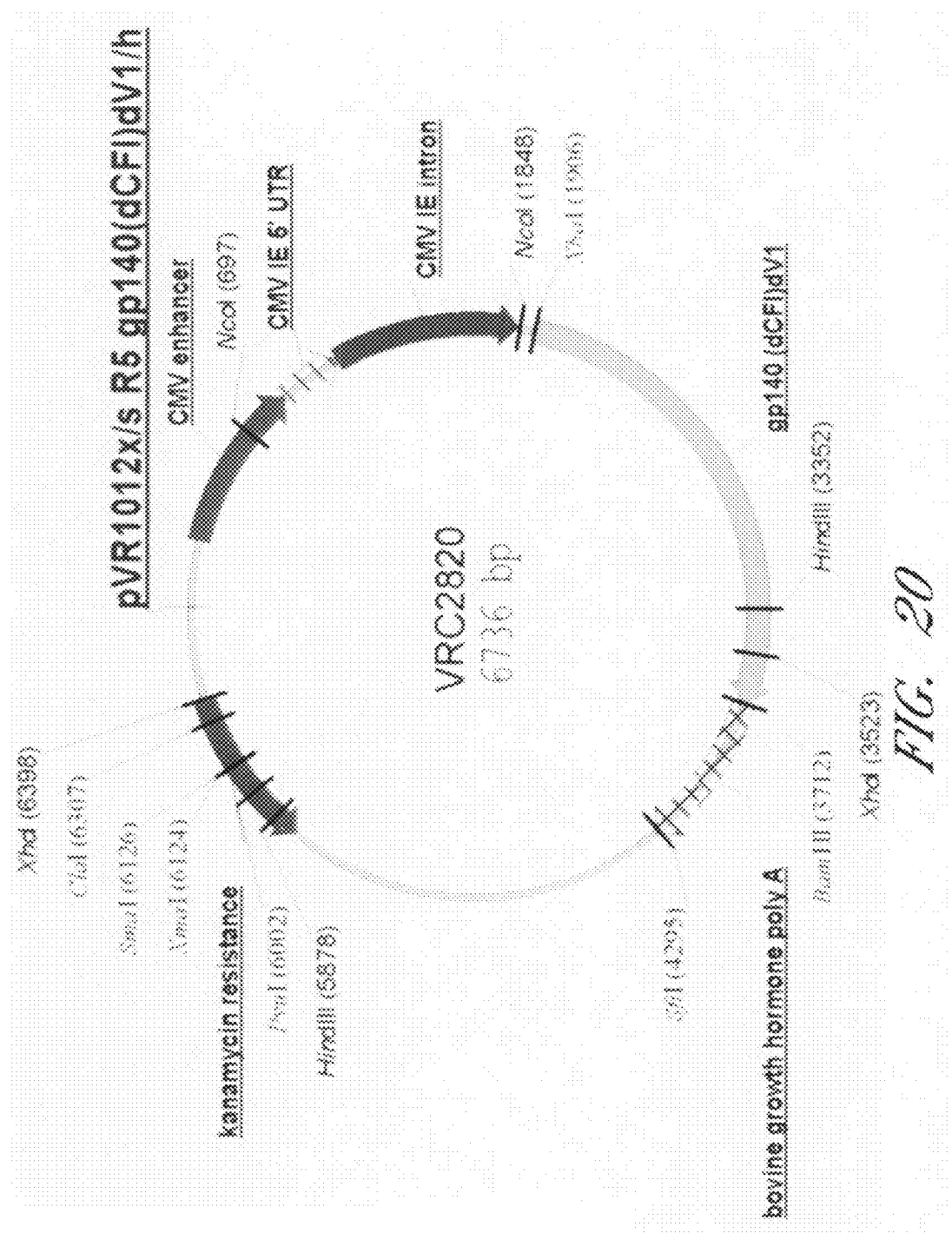
FIG. 20. Plasmid 2820.
Figure 21:
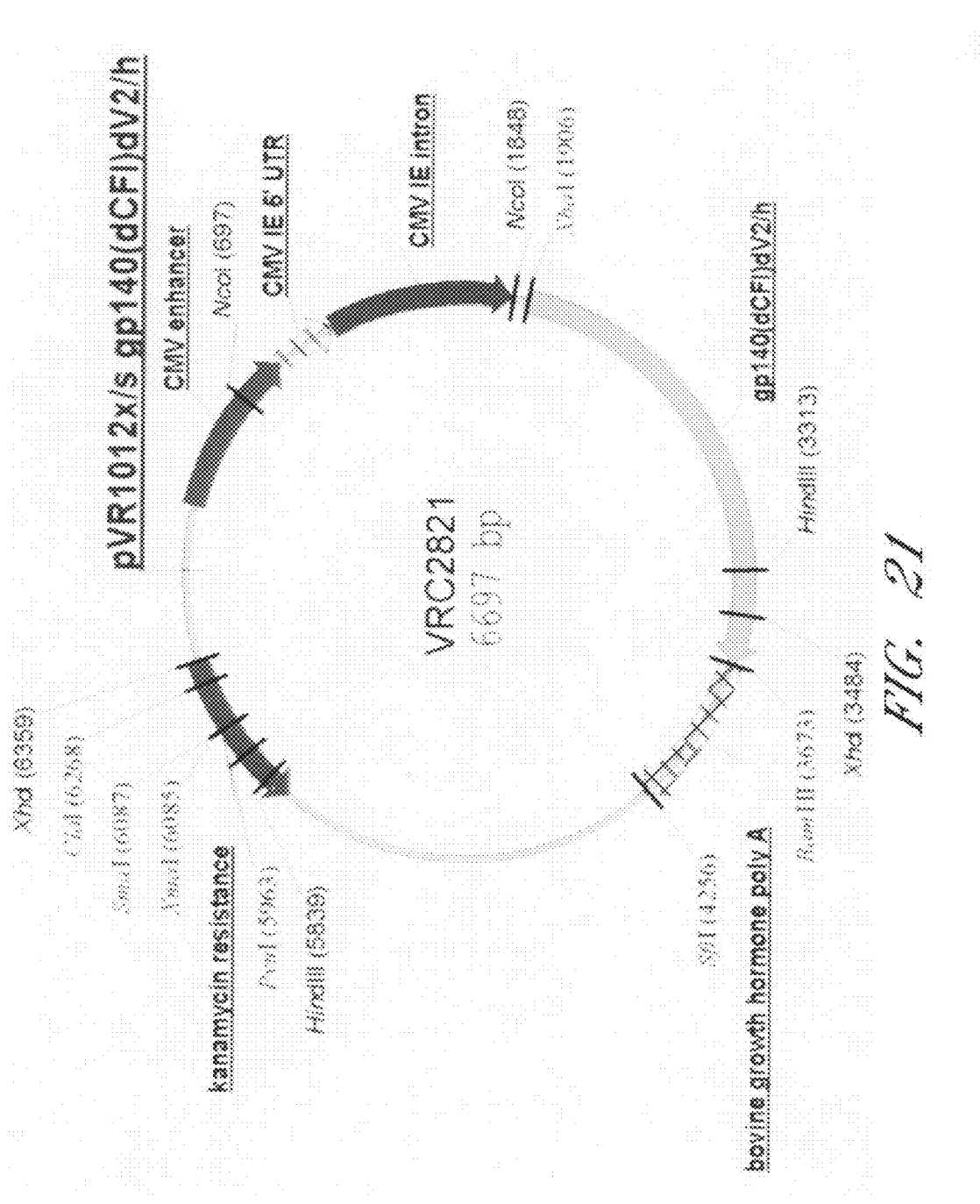
FIG. 21. Plasmid 2821.
Figure 22:
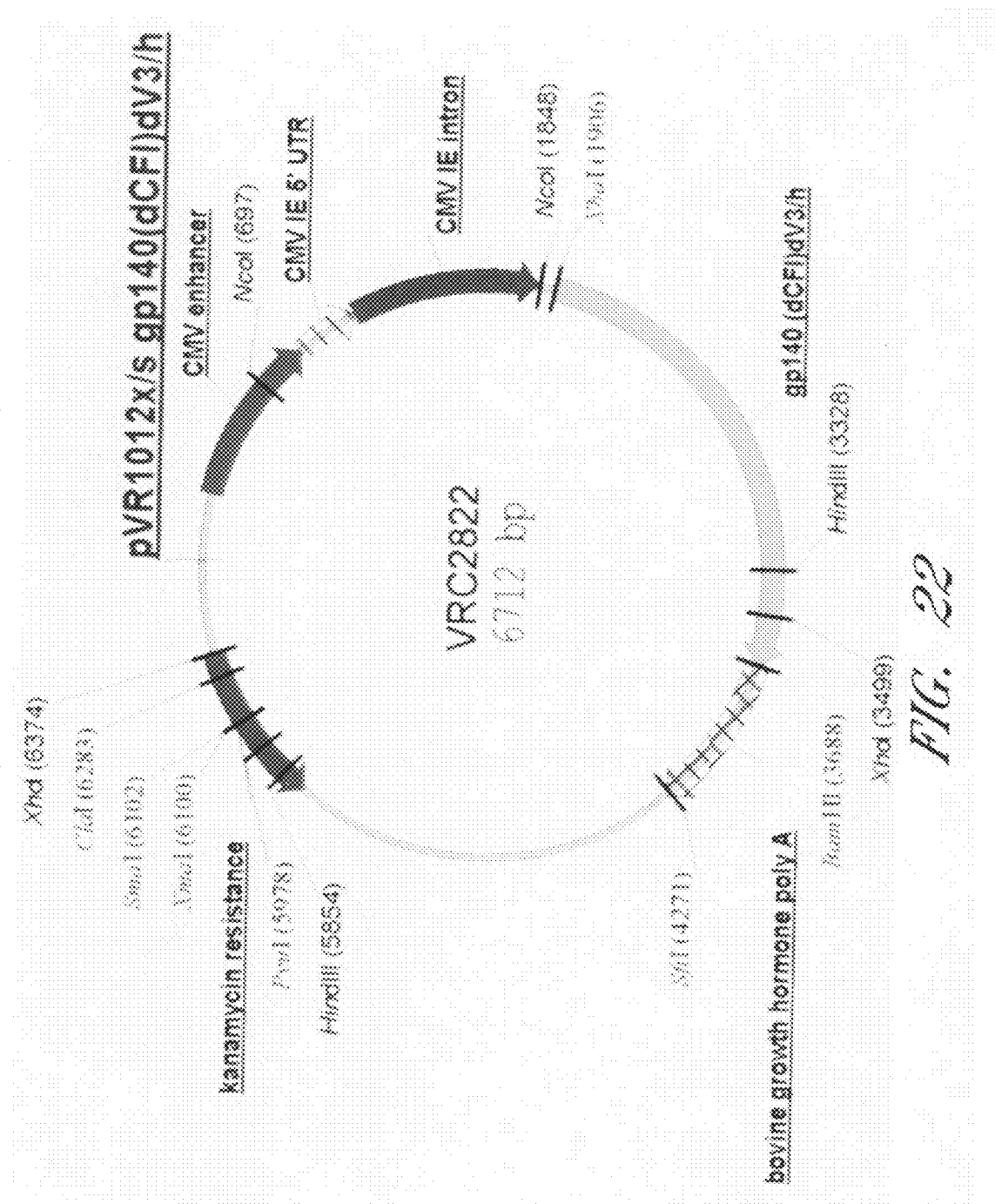
FIG. 22. Plasmid 2822.
Figure 23:
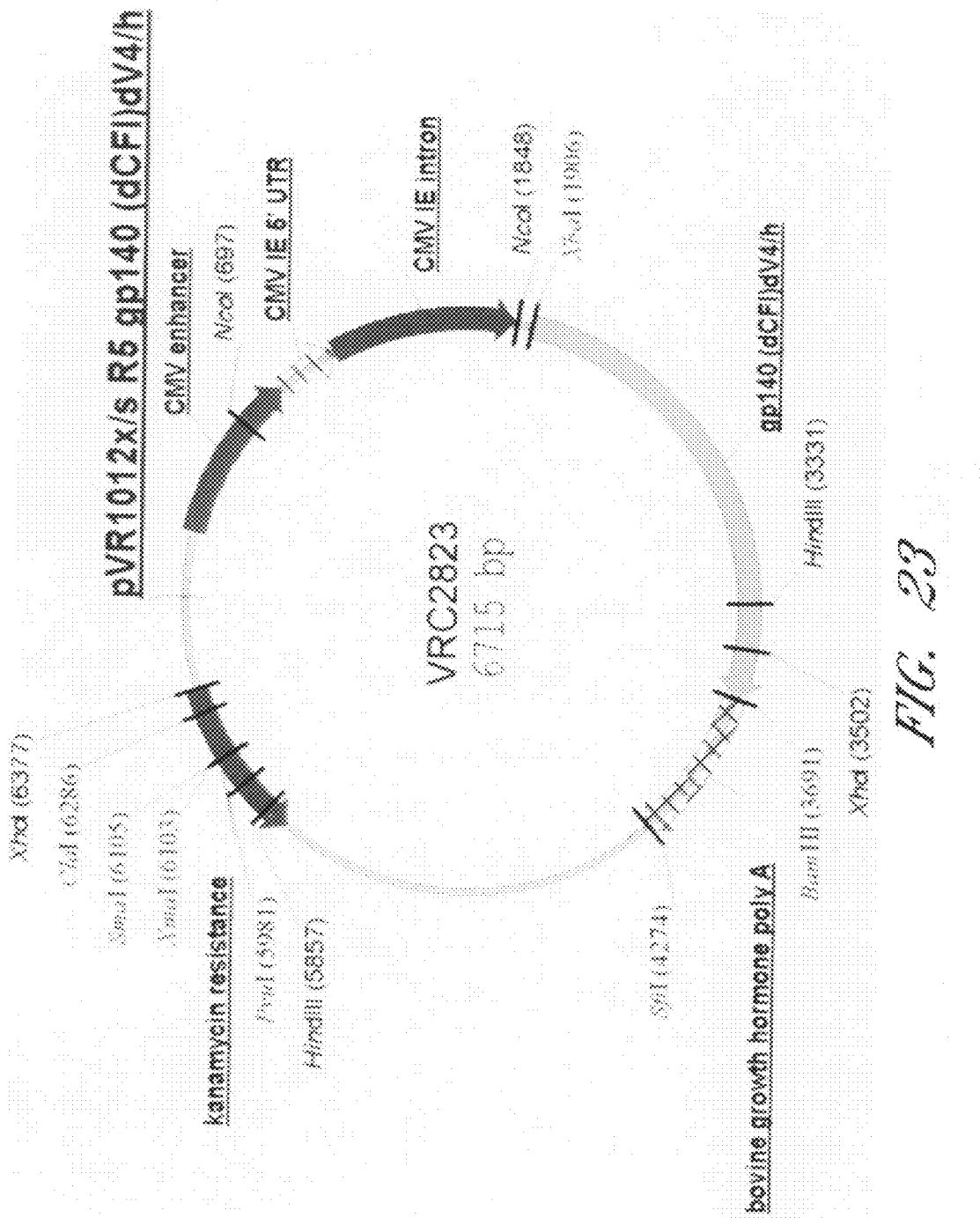
FIG. 23. Plasmid 2823.
Figure 24:
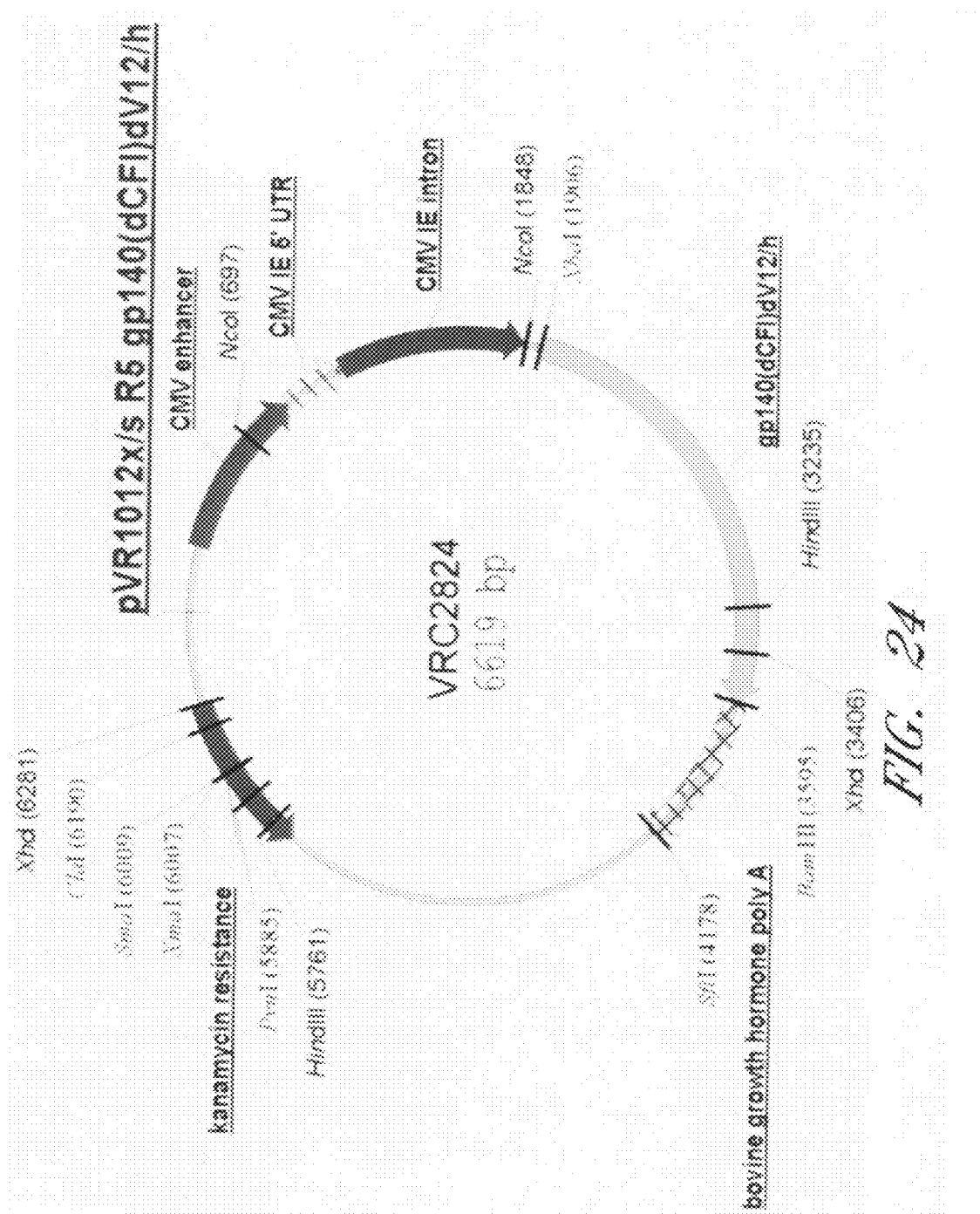
FIG. 24. Plasmid 2824.
Figure 25:
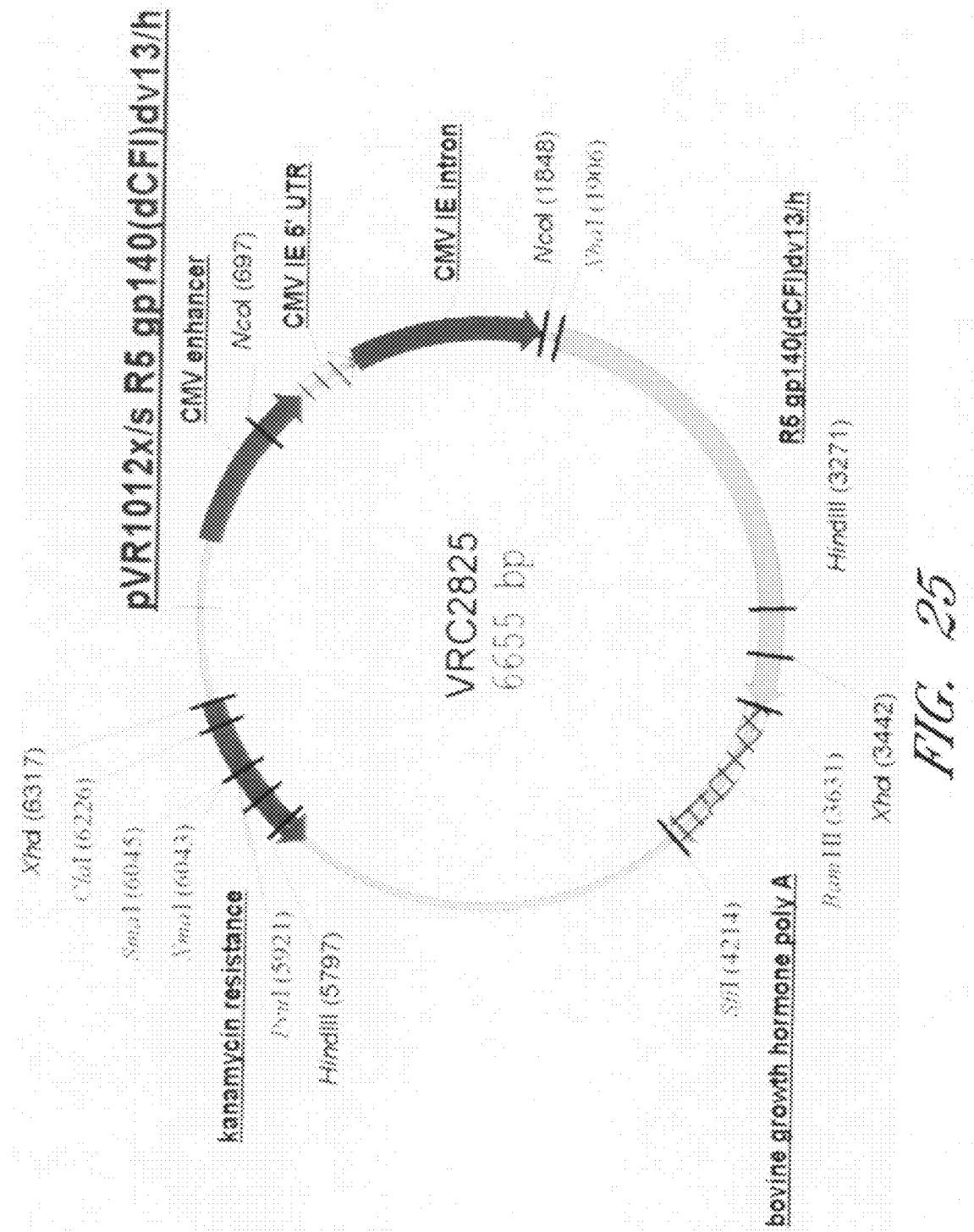
FIG. 25. Plasmid 2825.
Figure 26:
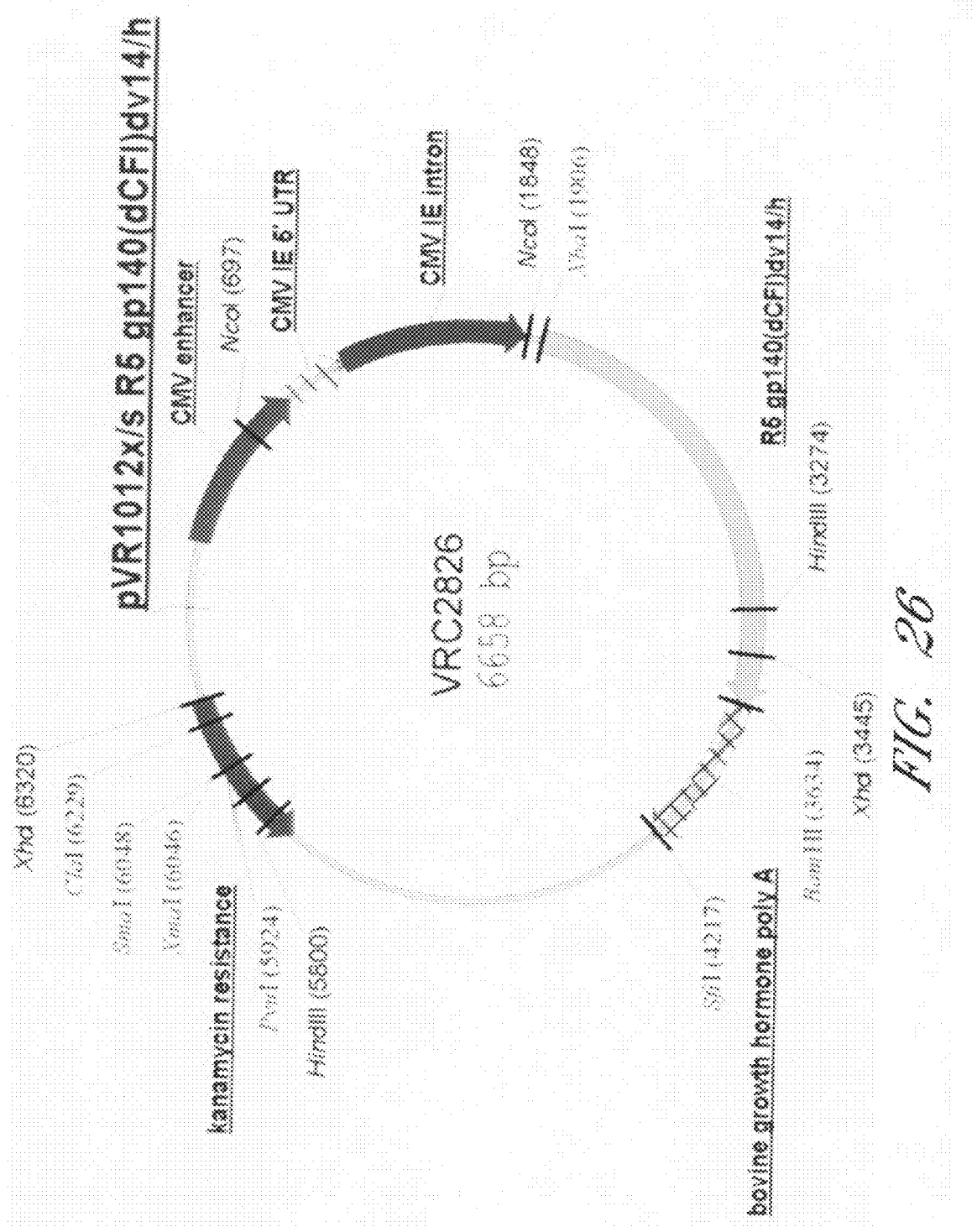
FIG. 26. Plasmid 2826.
Figure 27:
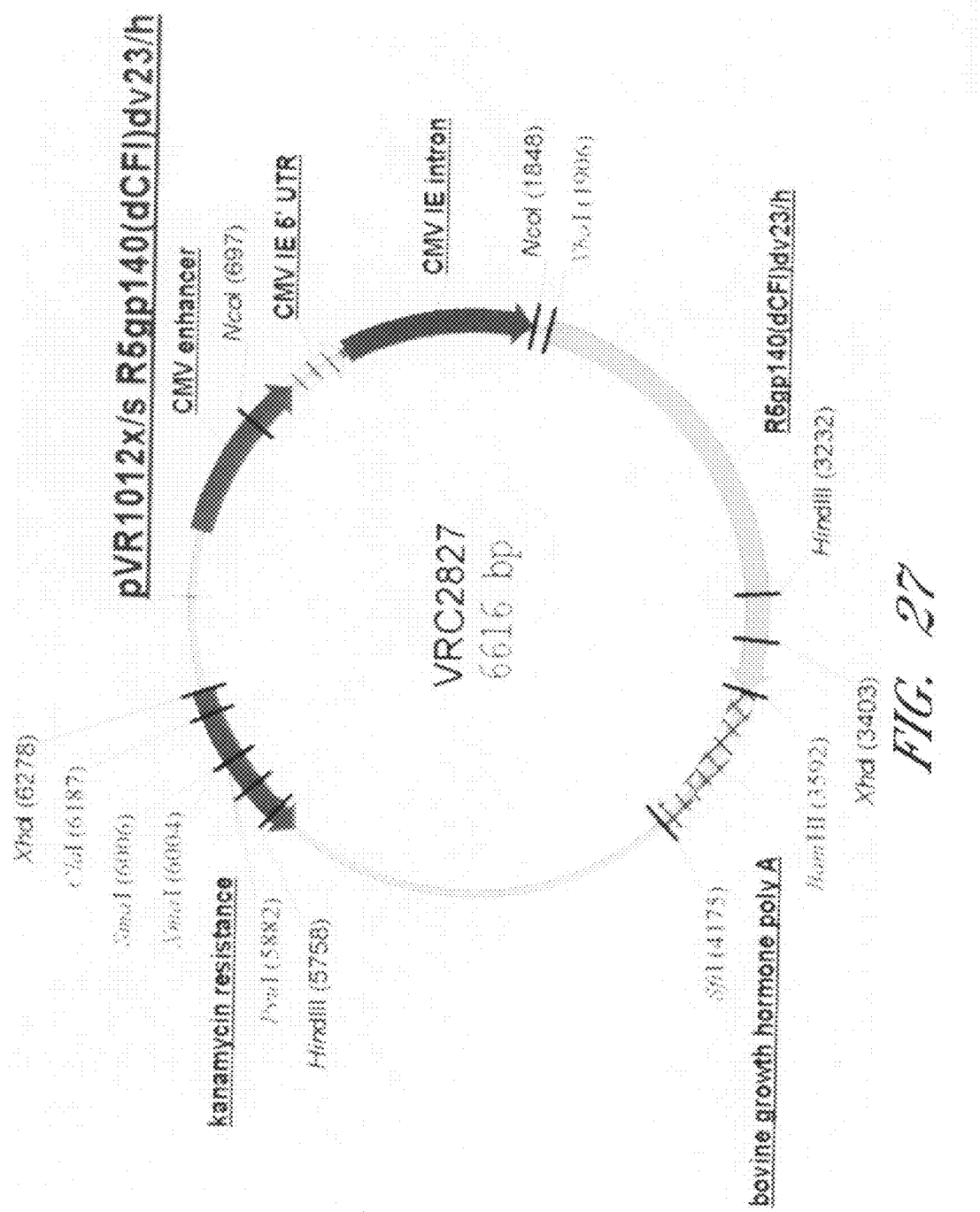
FIG. 27. Plasmid 2827.
Figure 28:
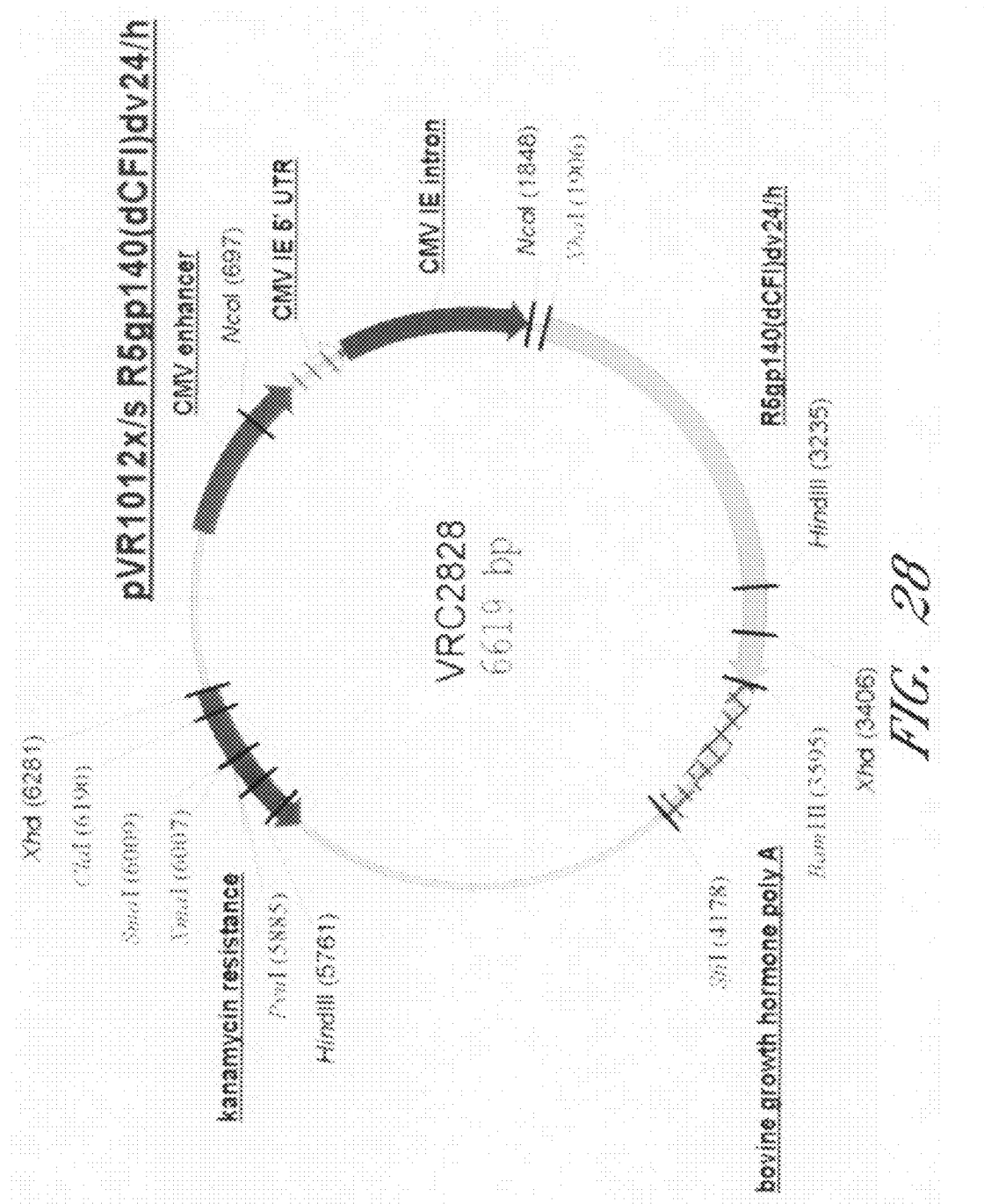
FIG. 28. Plasmid 2828.
Figure 29:
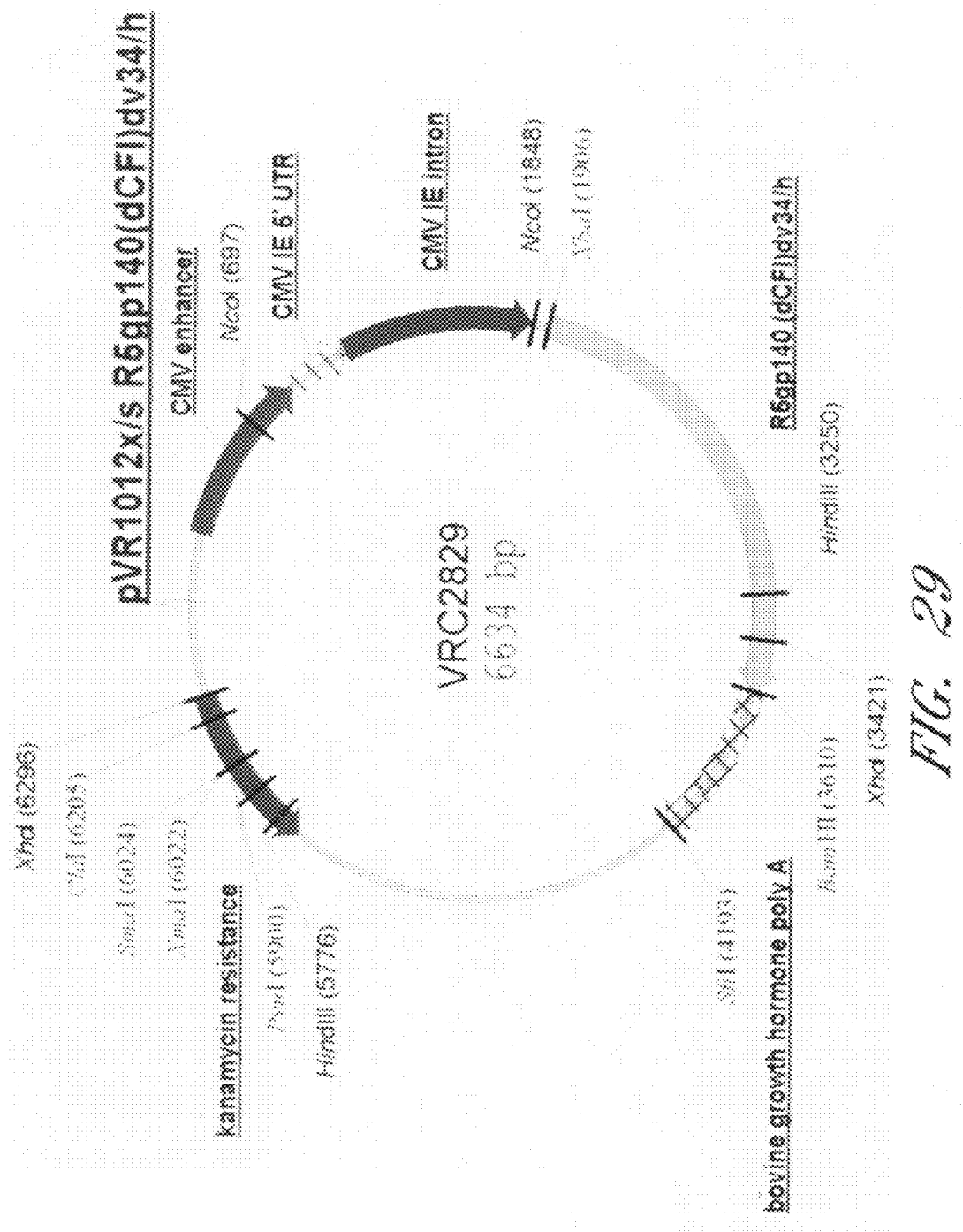
FIG. 29. Plasmid 2829.
Figure 30:
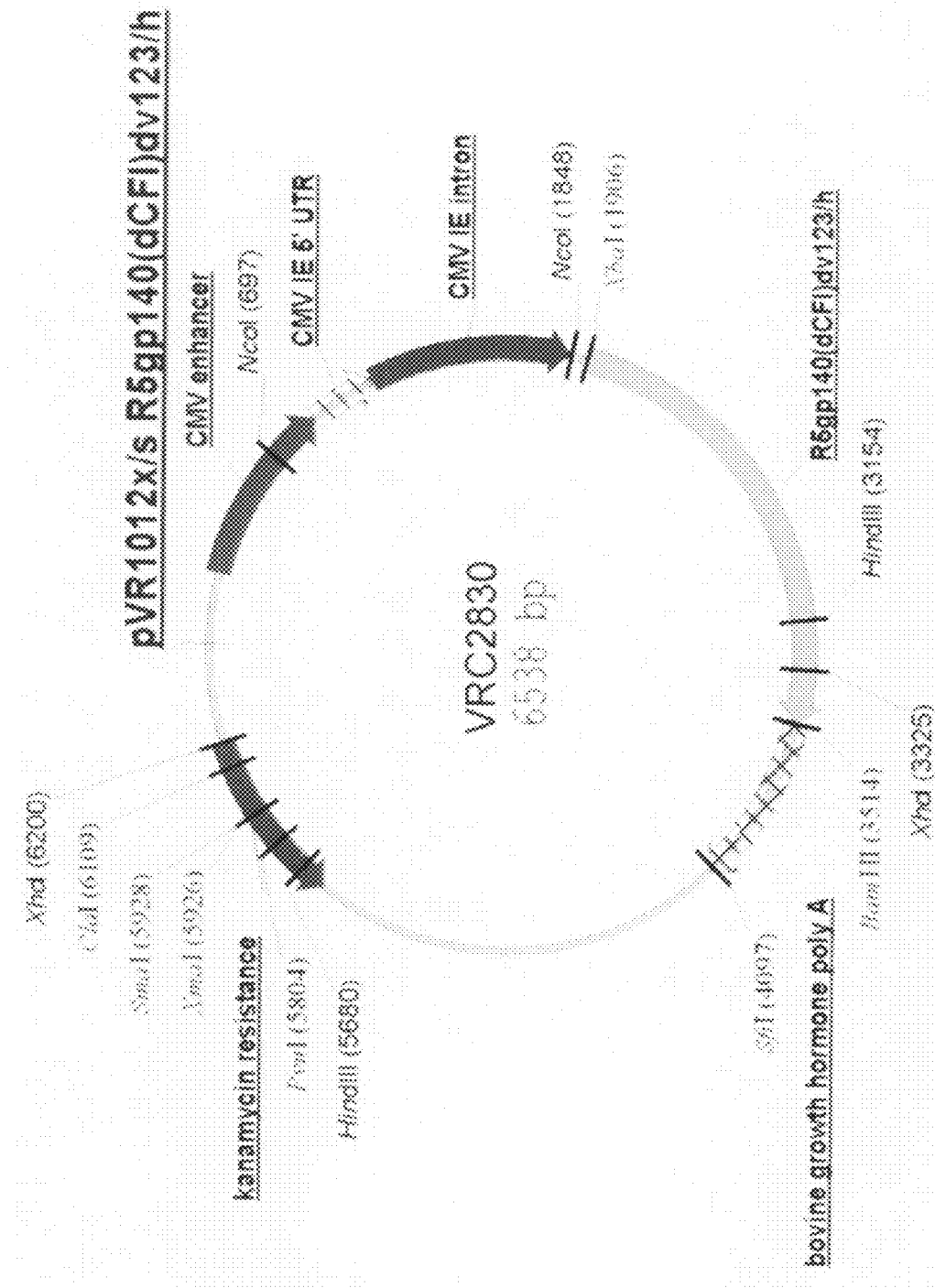
FIG. 30. Plasmid 2830.
Figure 31:
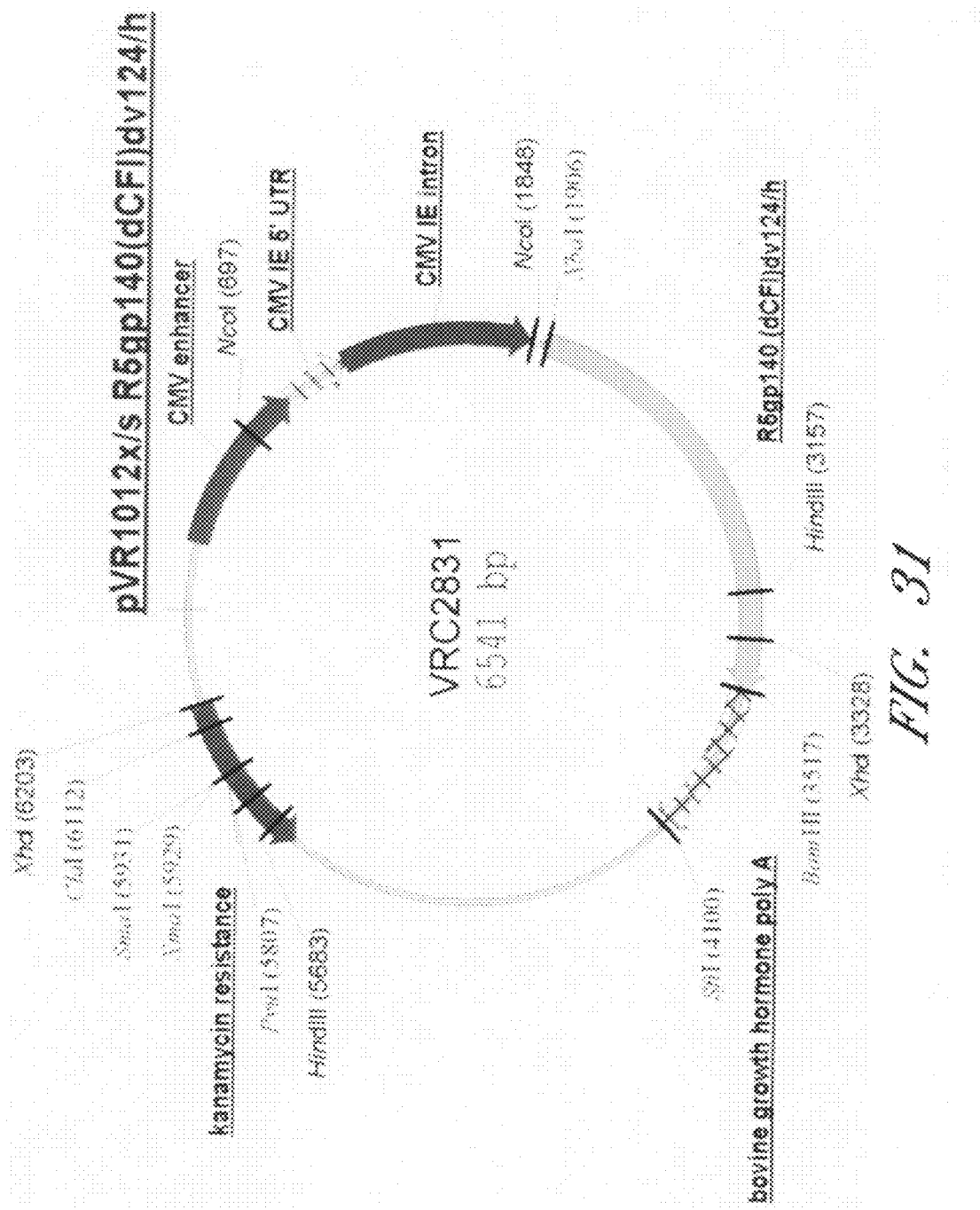
FIG. 31. Plasmid 2831.
Figure 32:
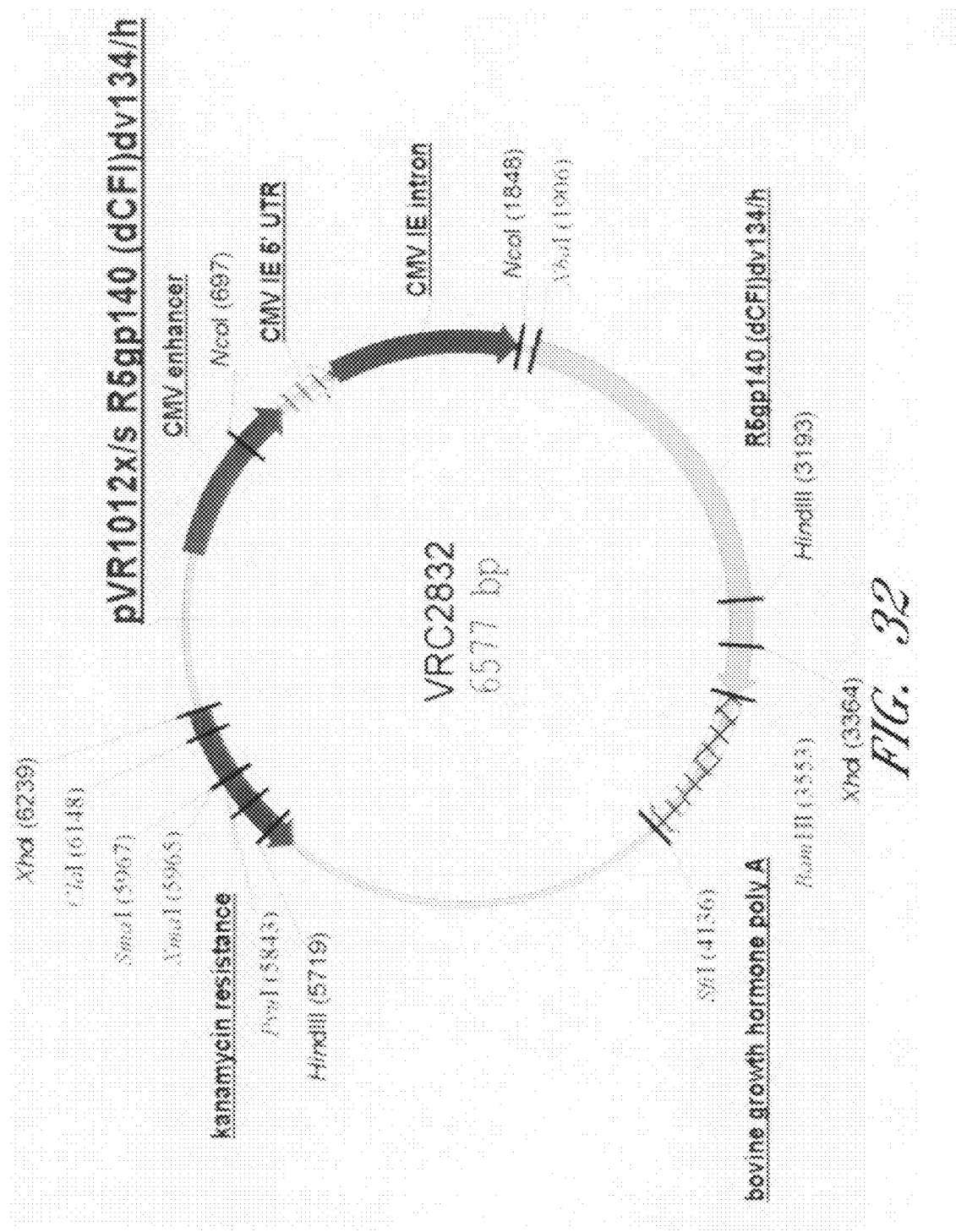
FIG. 32. Plasmid 2832.
Figure 33:
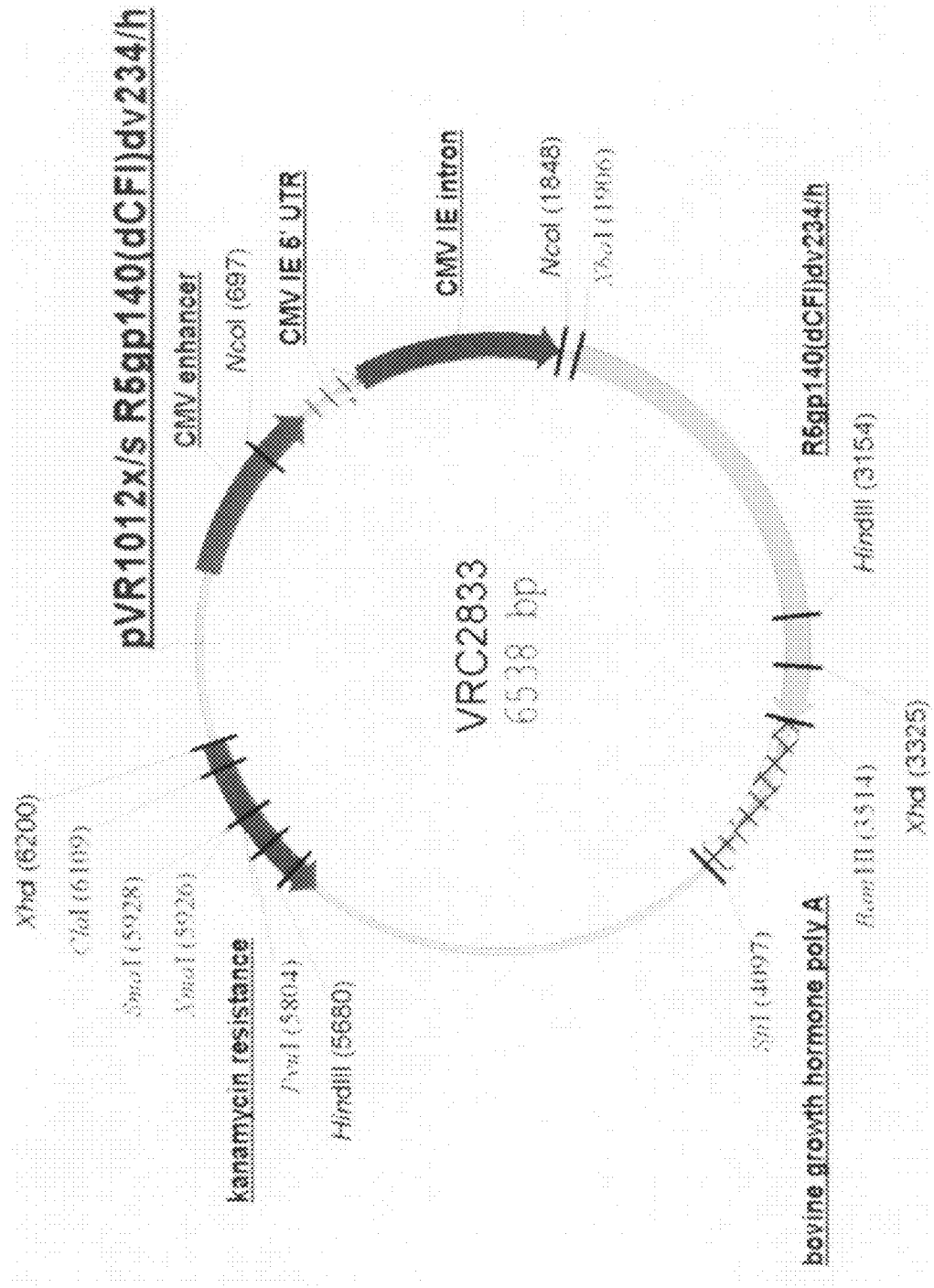
FIG. 33. Plasmid 2833.
Figure 34:
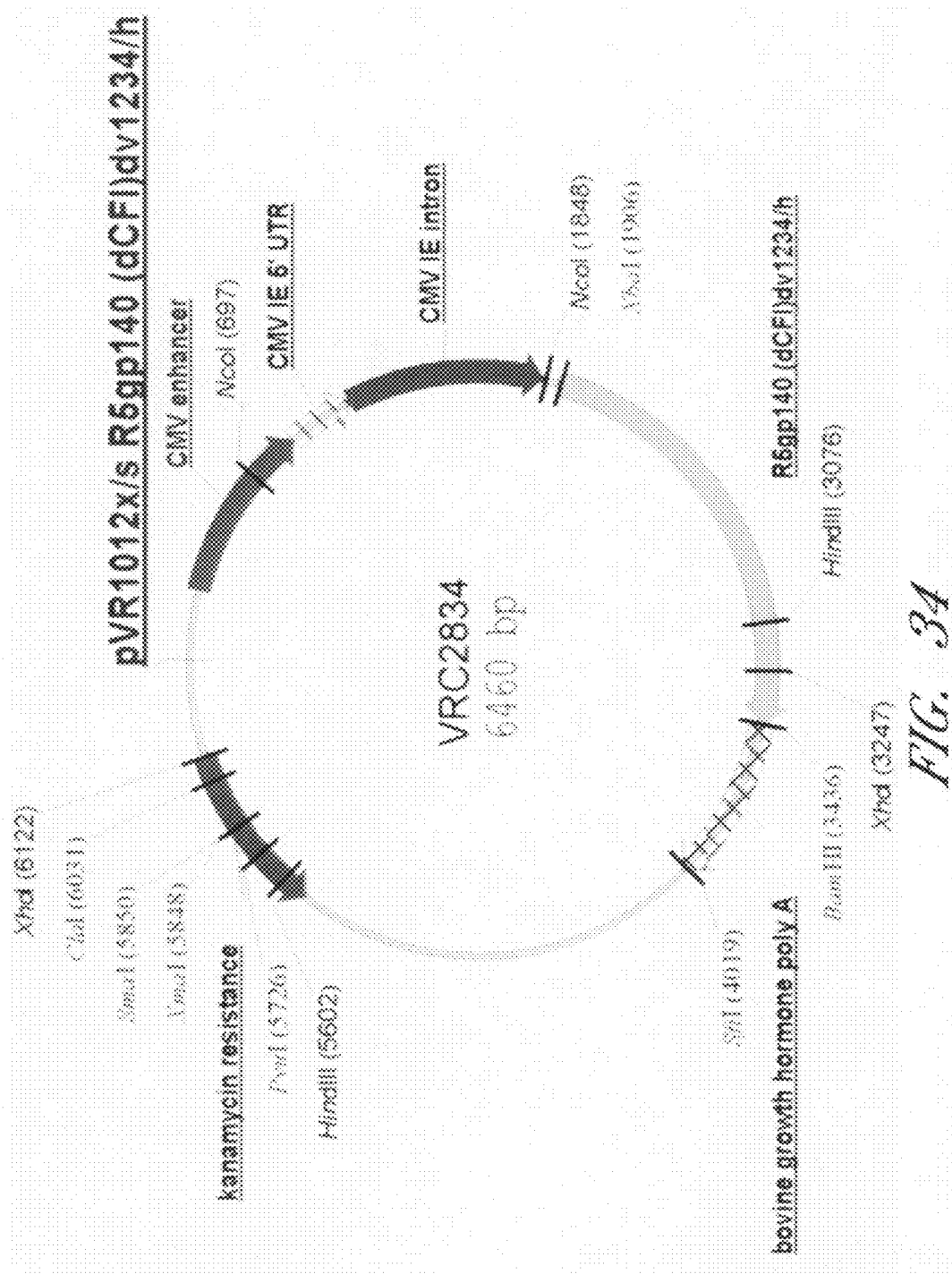
FIG. 34. Plasmid 2834.
Figure 35:
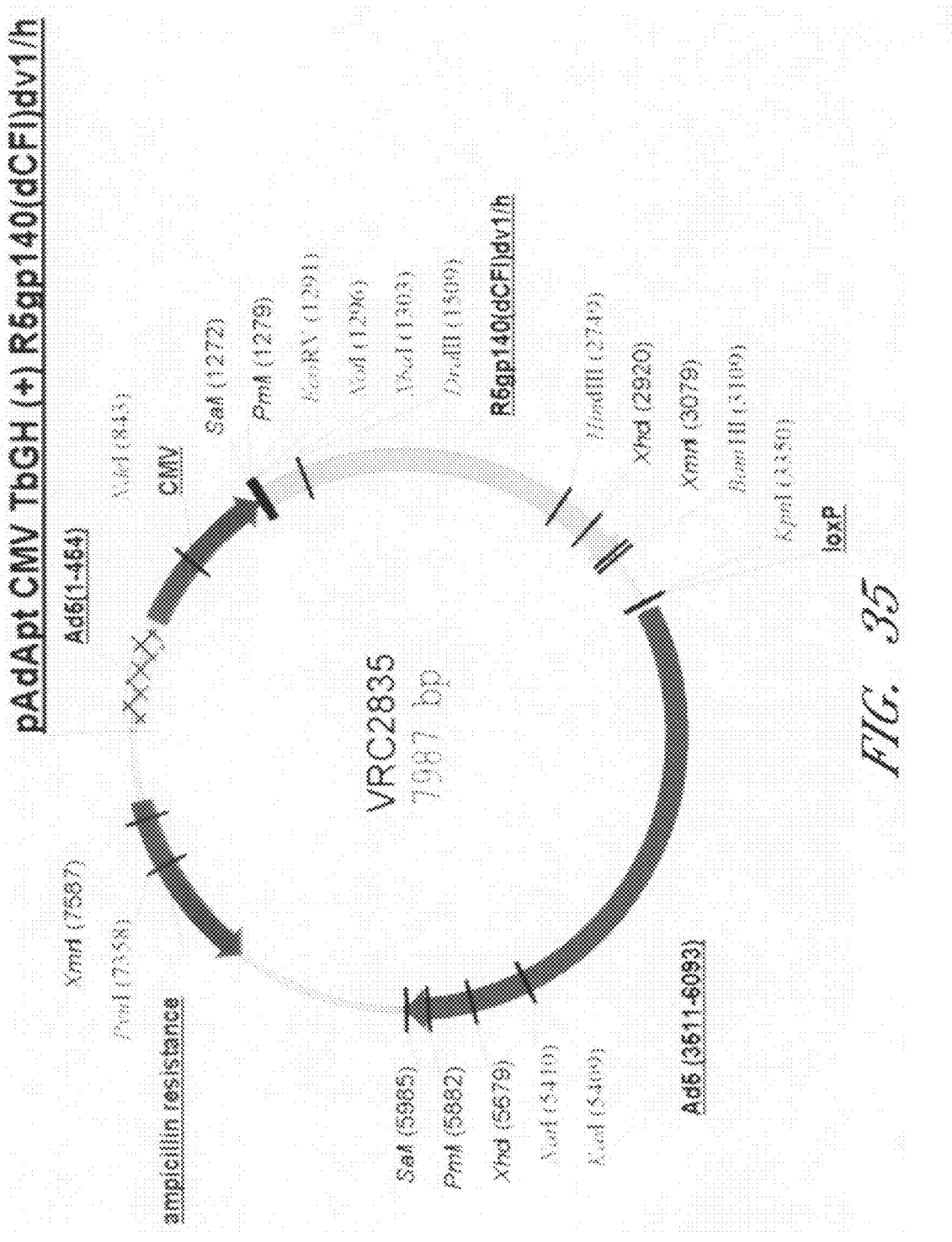
FIG. 35. Plasmid 2835.
Figure 36:
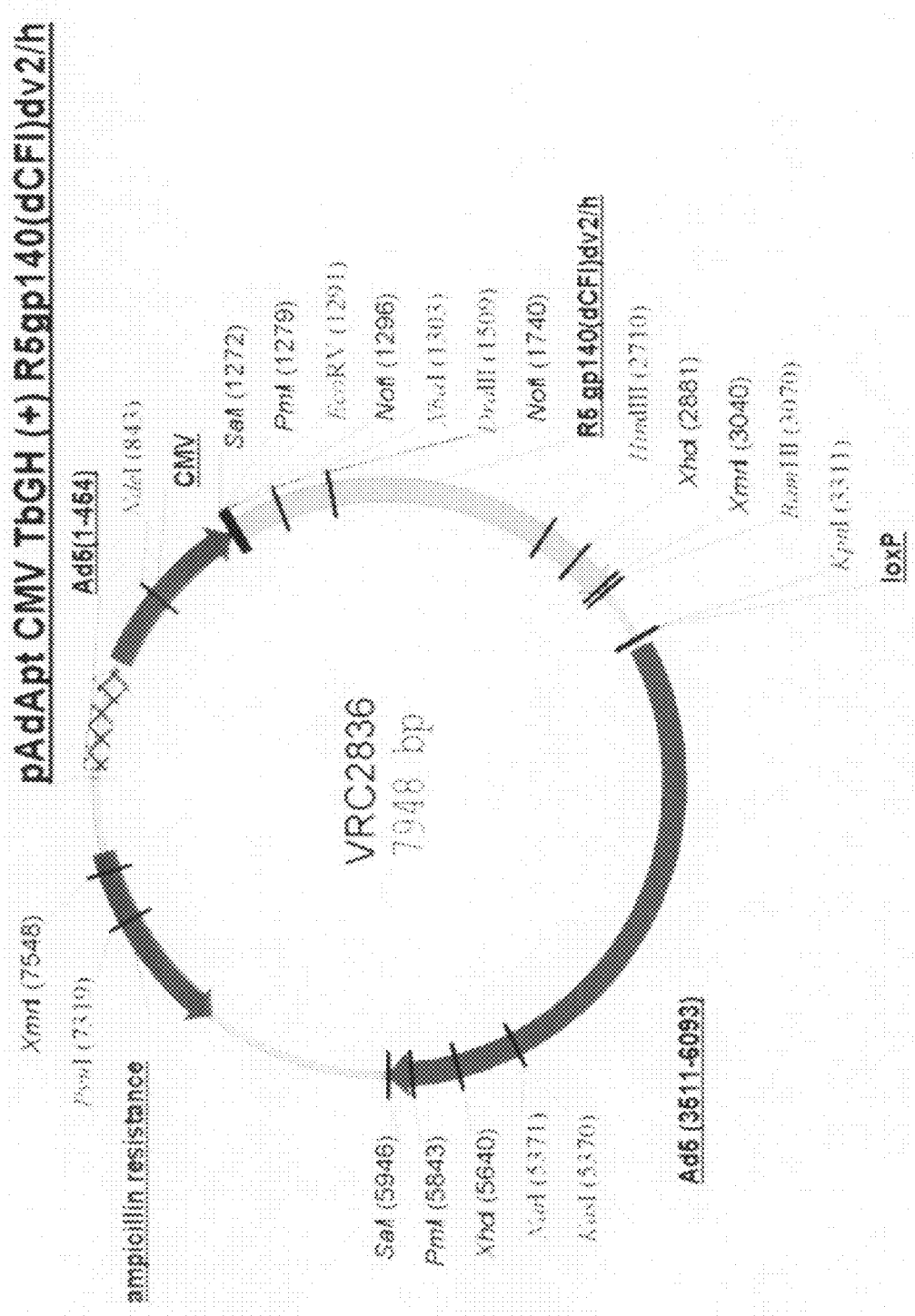
FIG. 36. Plasmid 2836.
Figure 37:
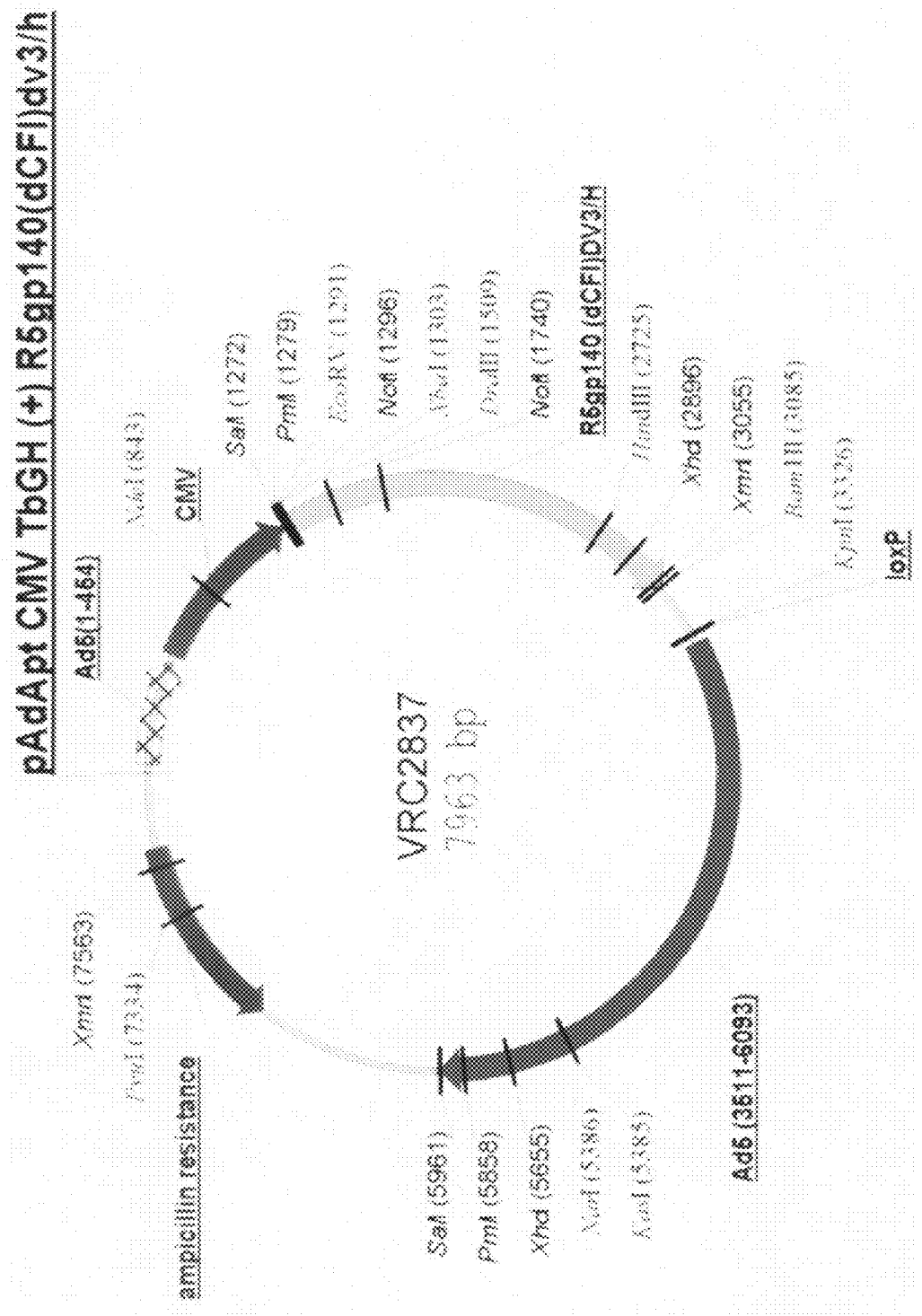
FIG. 37. Plasmid 2837.
Figure 38:
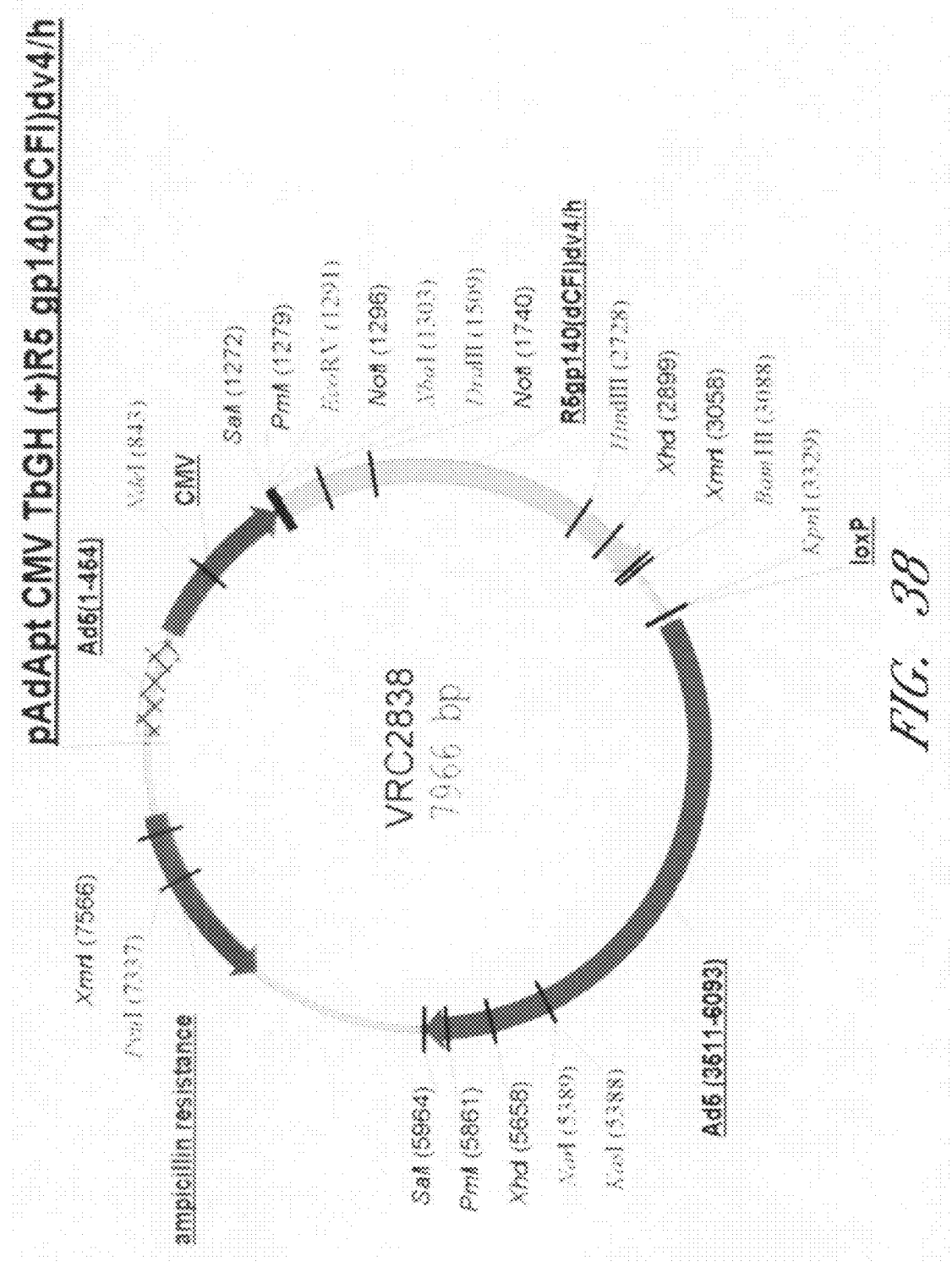
FIG. 38. Plasmid 2838.
Figure 39:
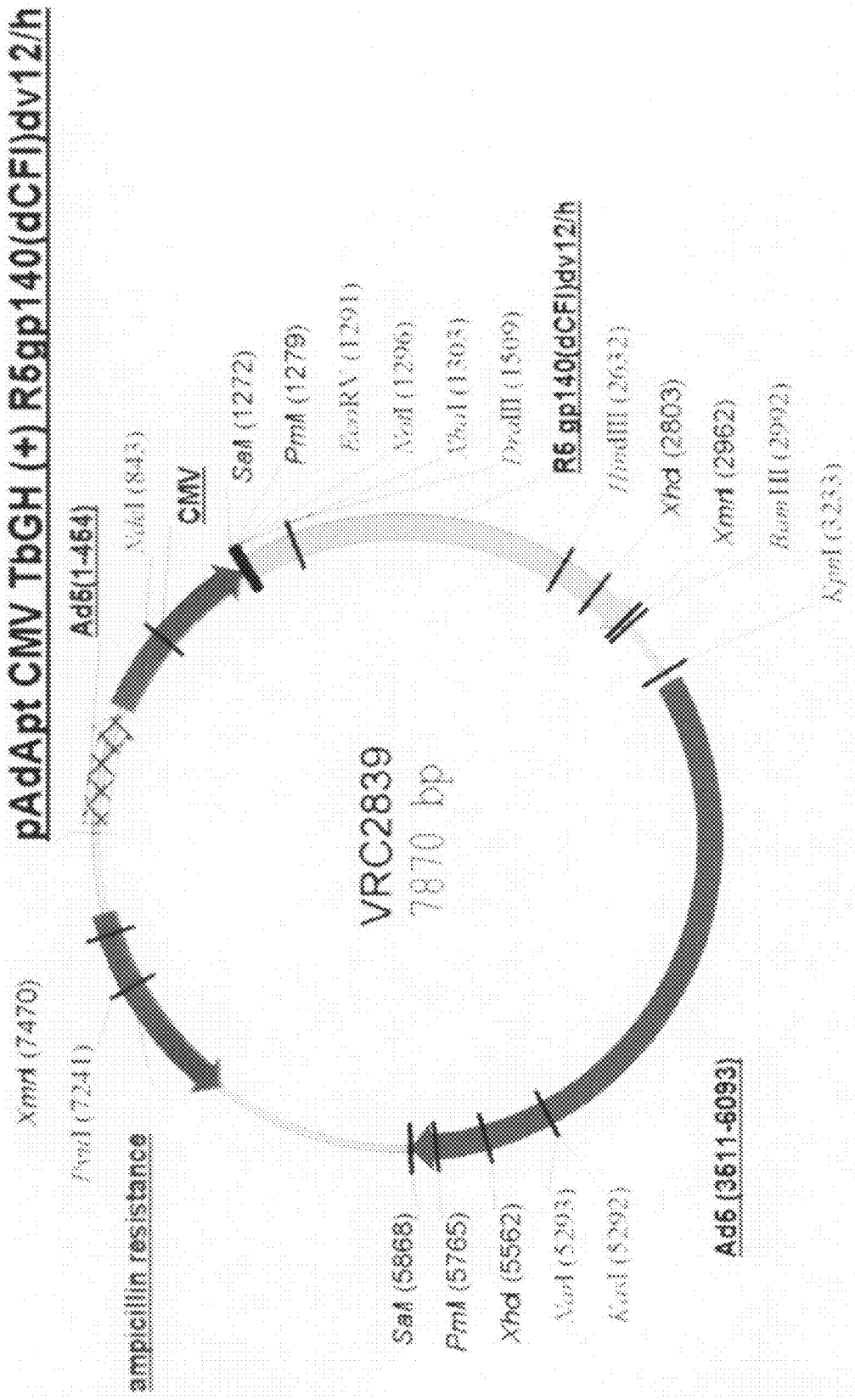
FIG. 39. Plasmid 2839.
Figure 40:
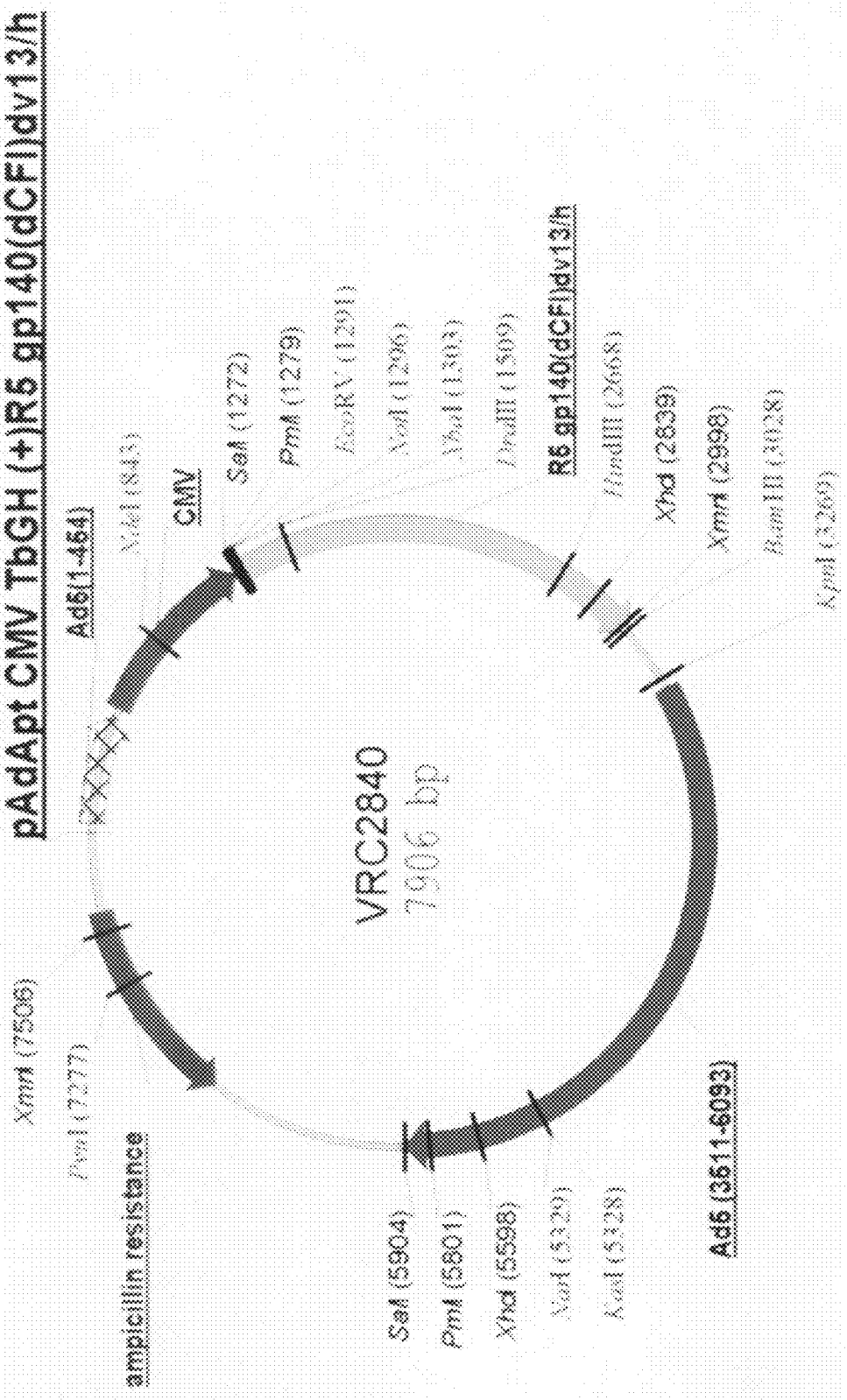
FIG. 40. Plasmid 2840.
Figure 41:
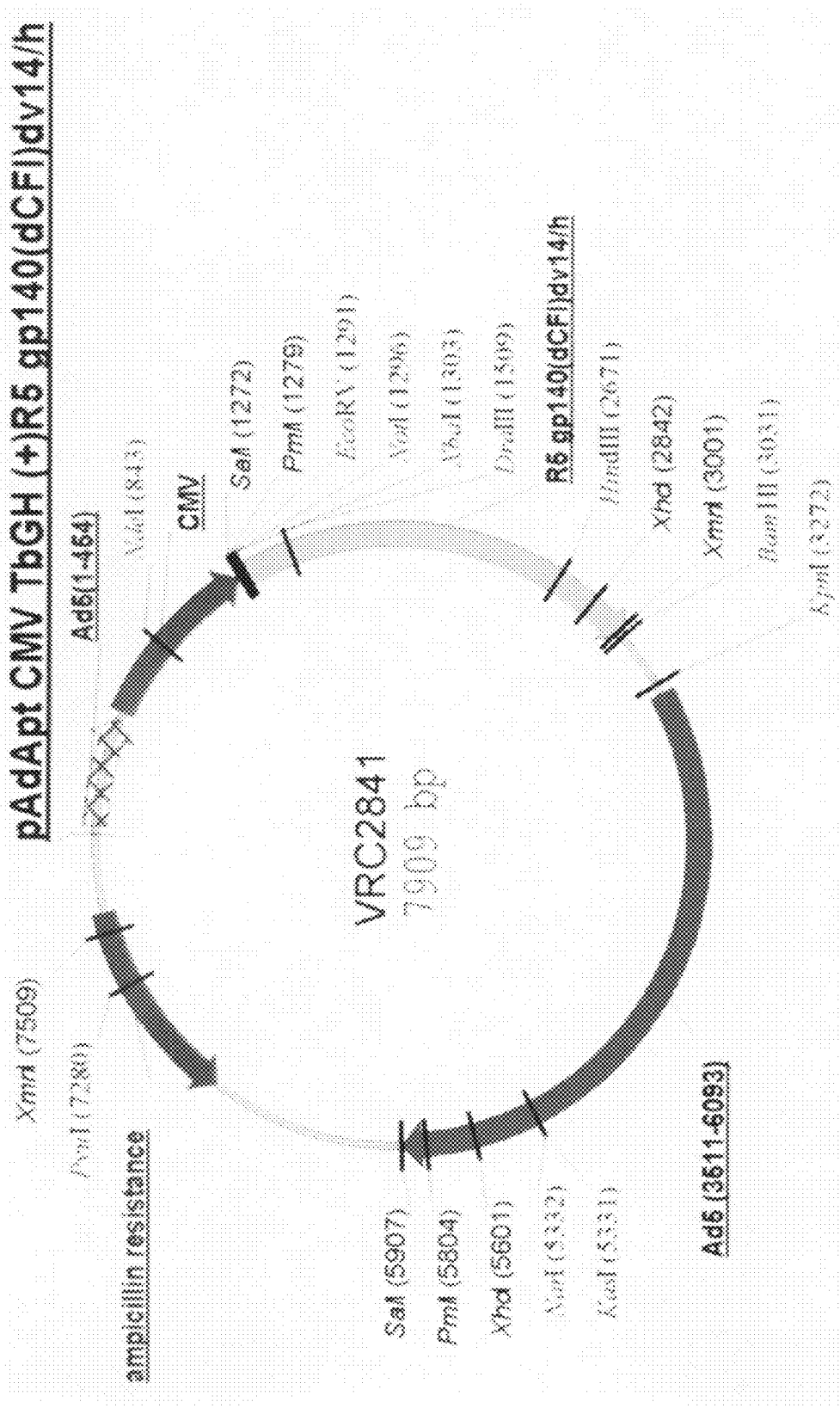
FIG. 41. Plasmid 2841.
Figure 42:
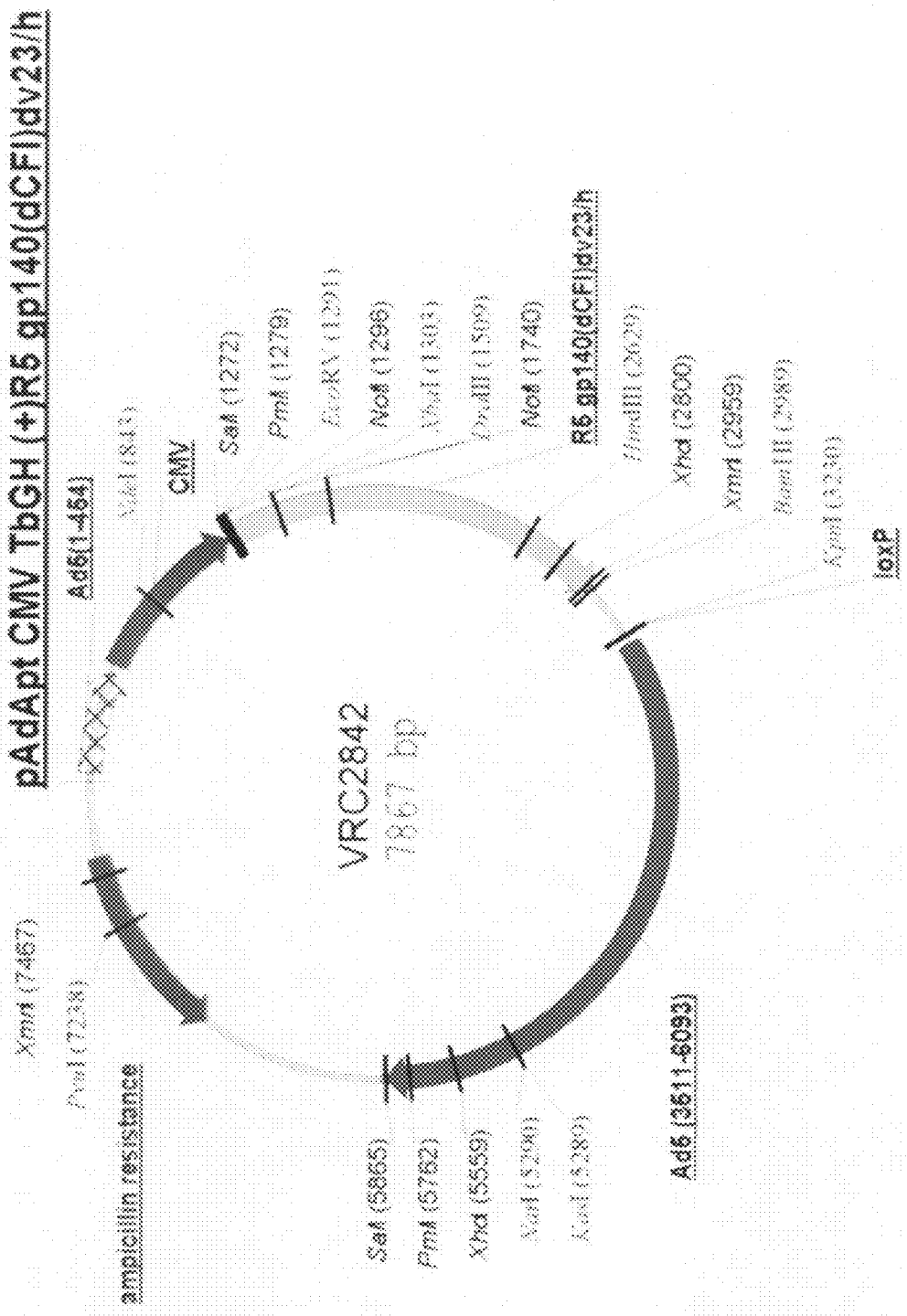
FIG. 42. Plasmid 2842.
Figure 43:
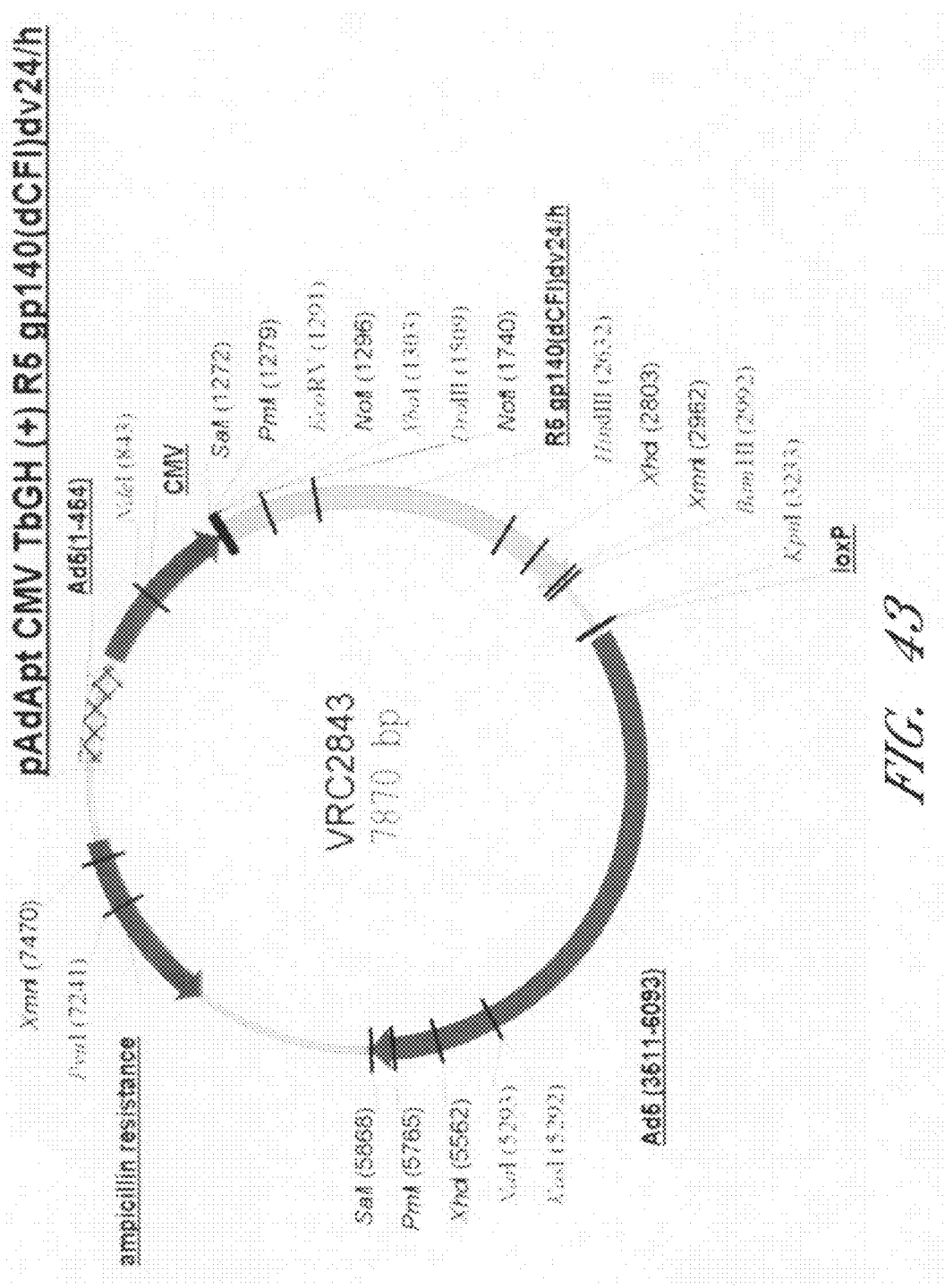
FIG. 43. Plasmid 2843.
Figure 44:
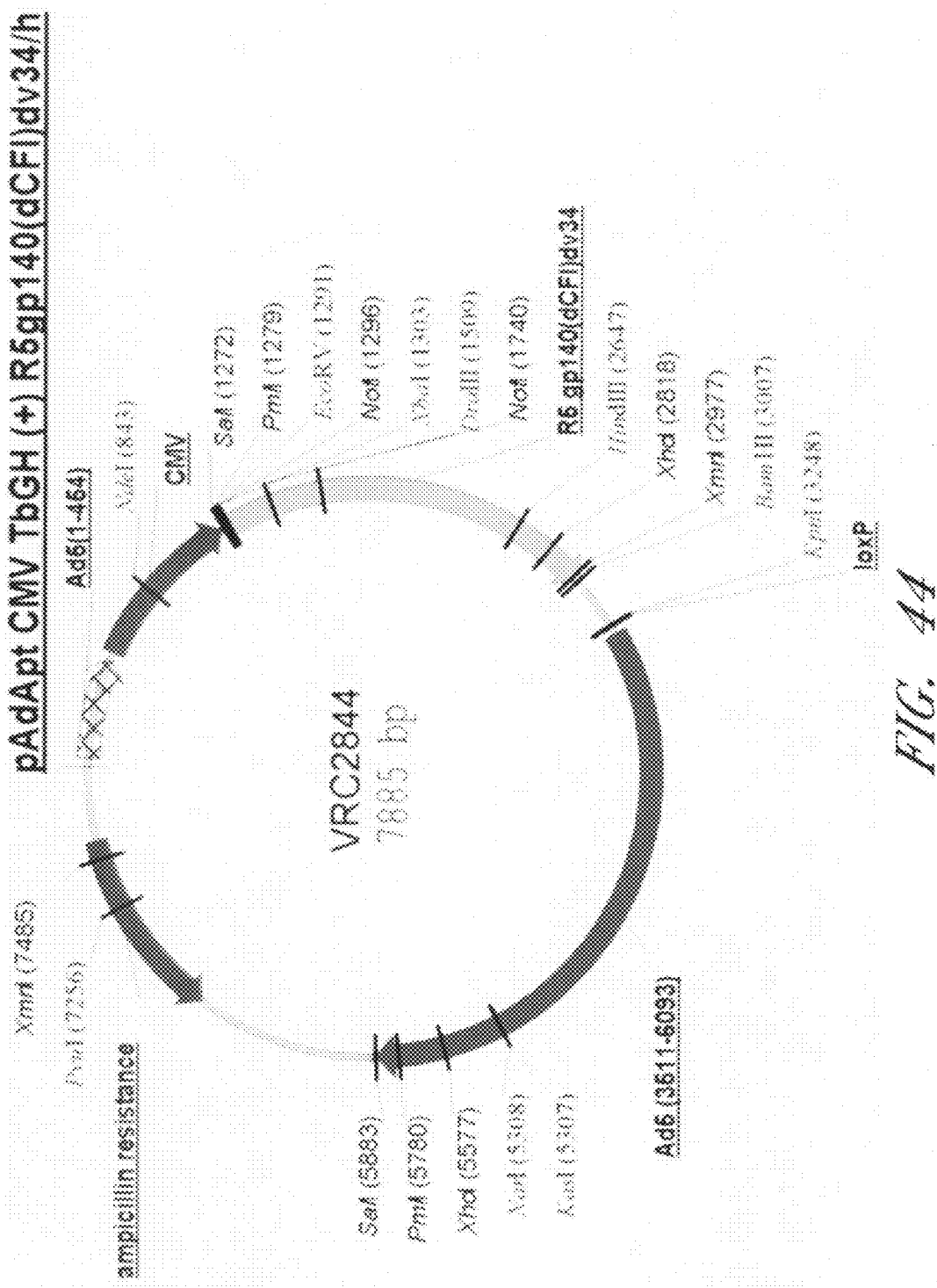
FIG. 44. Plasmid 2844.
Figure 45:
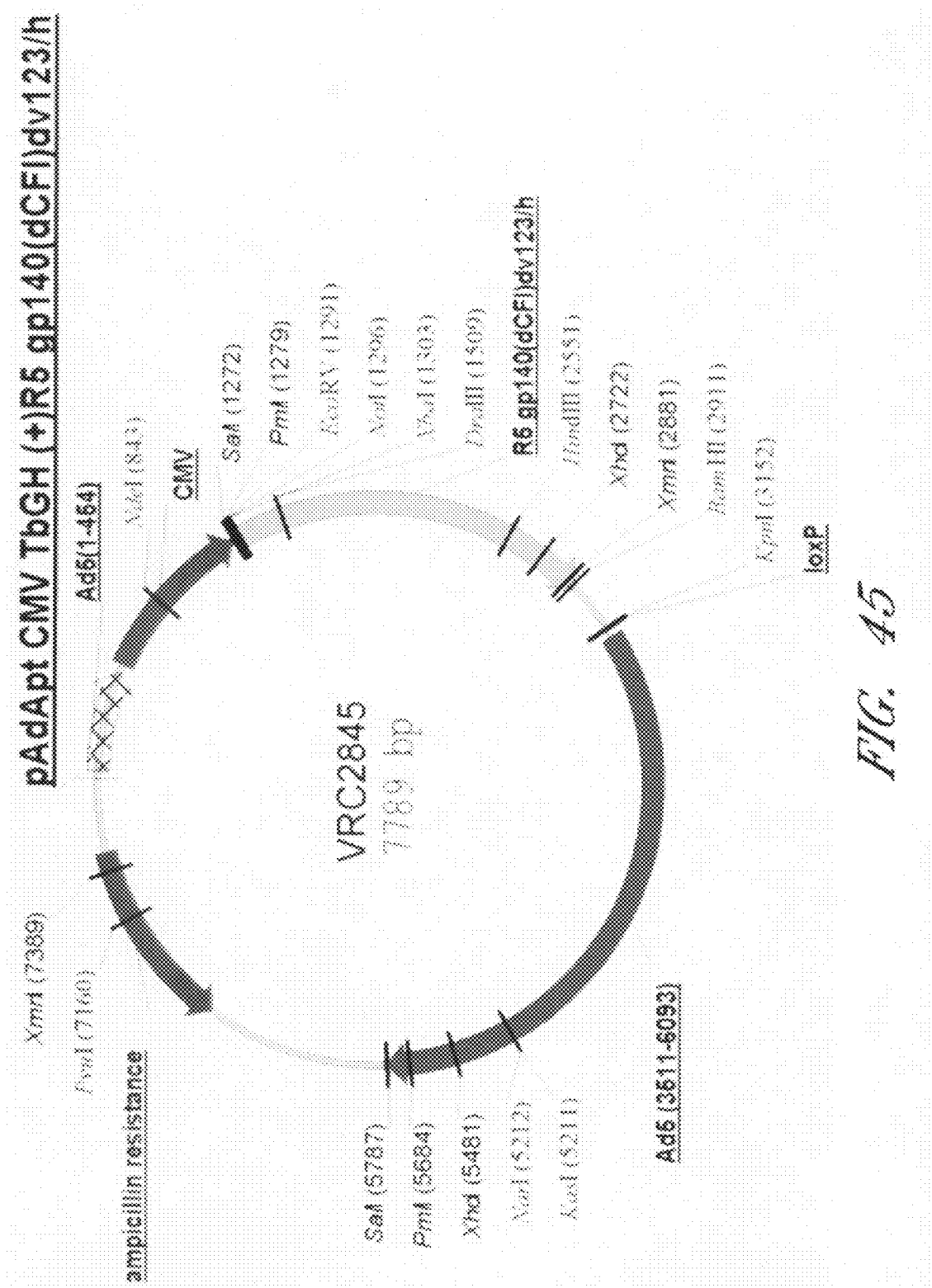
FIG. 45. Plasmid 2845.
Figure 46:
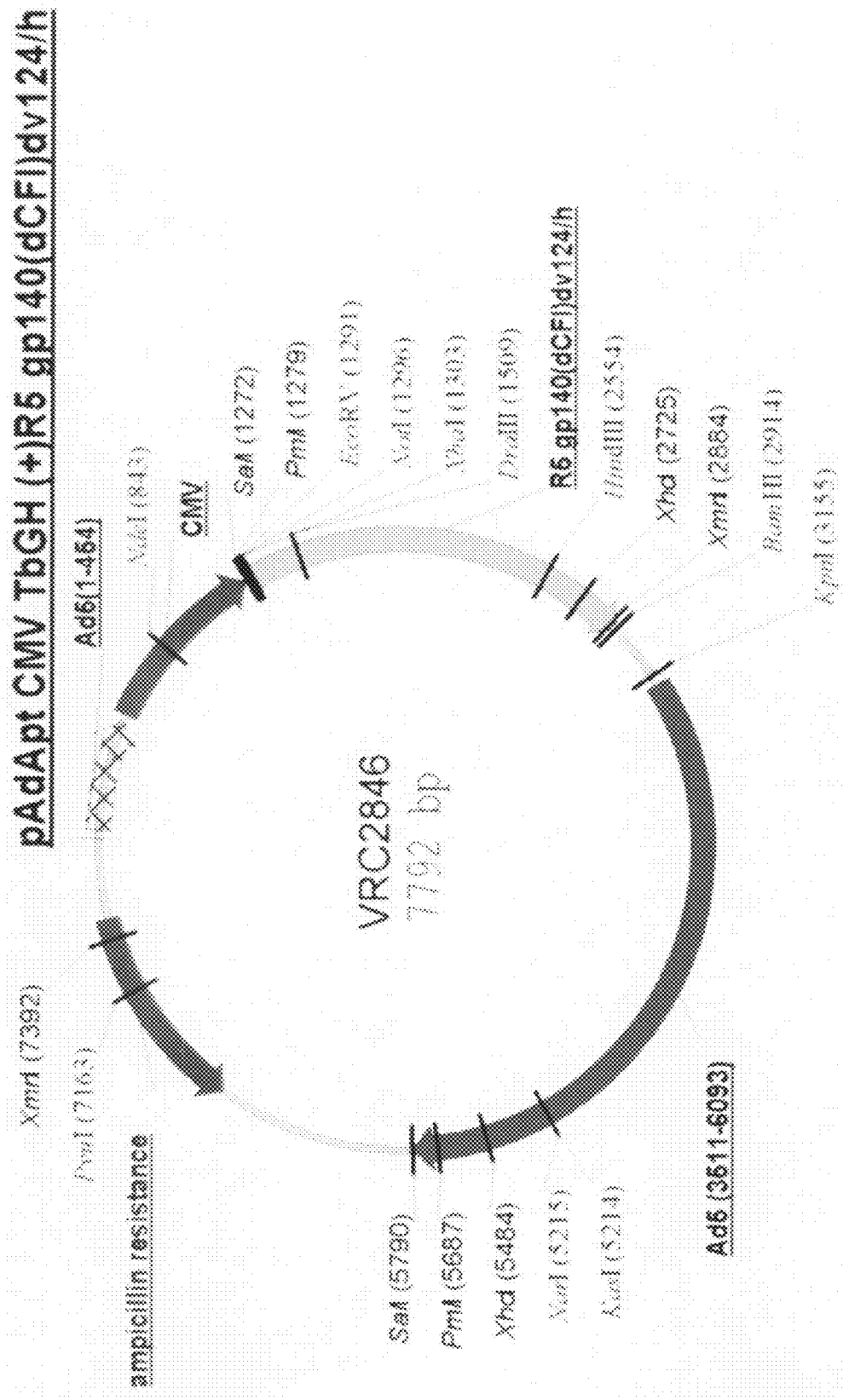
FIG. 46. Plasmid 2846.
Figure 47:
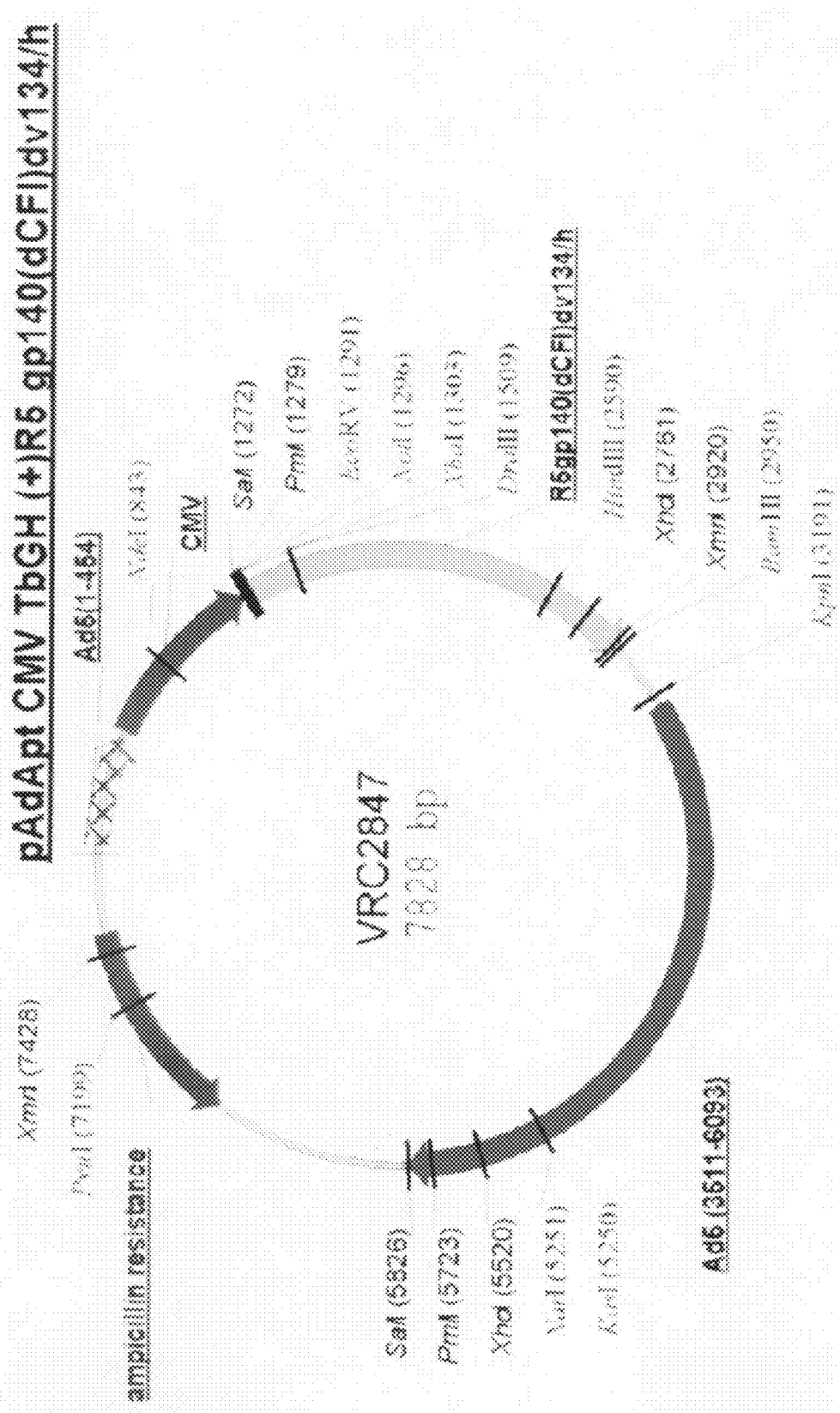
FIG. 47. Plasmid 2847.
Figure 48:
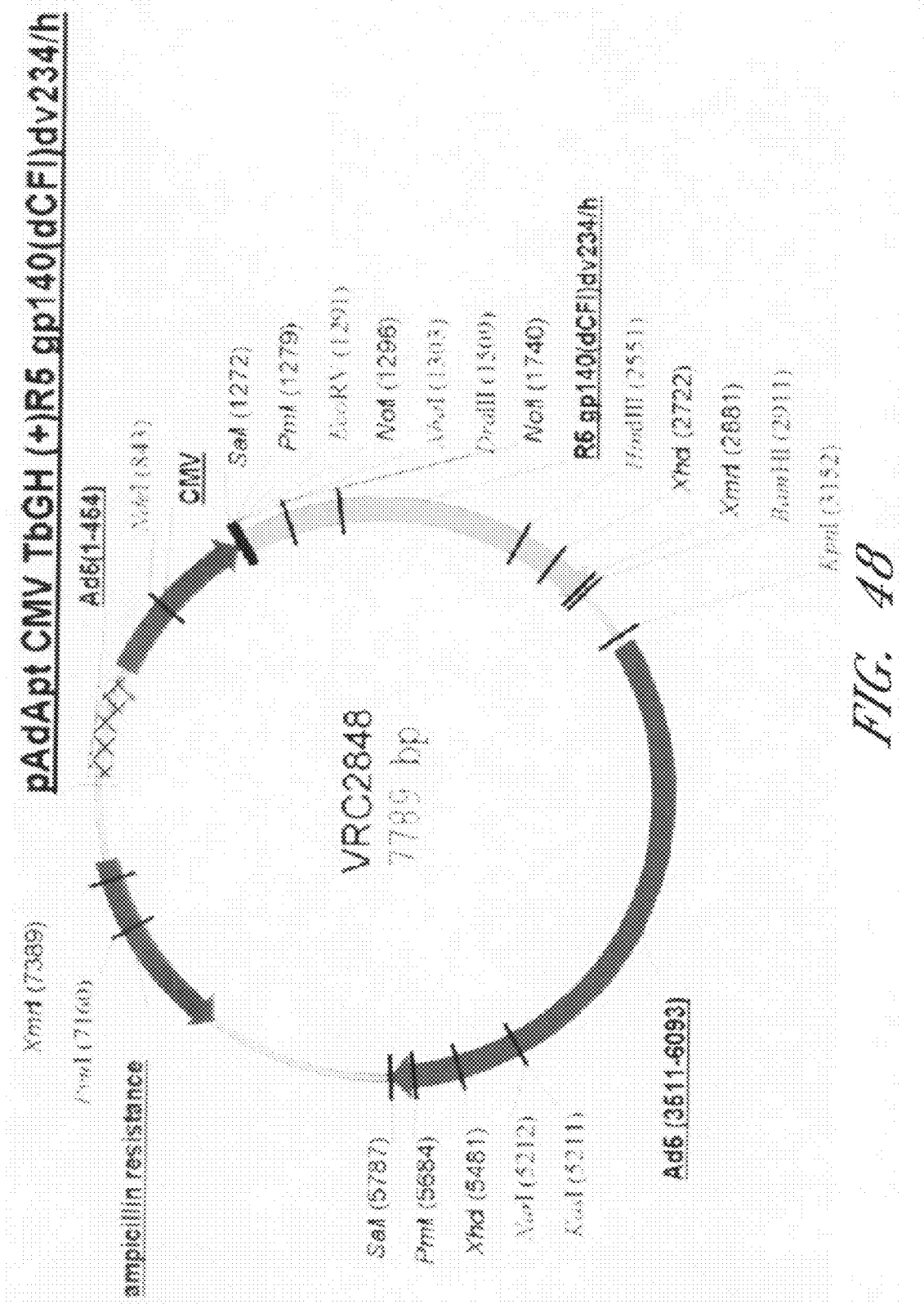
FIG. 48. Plasmid 2848.
Figure 49:
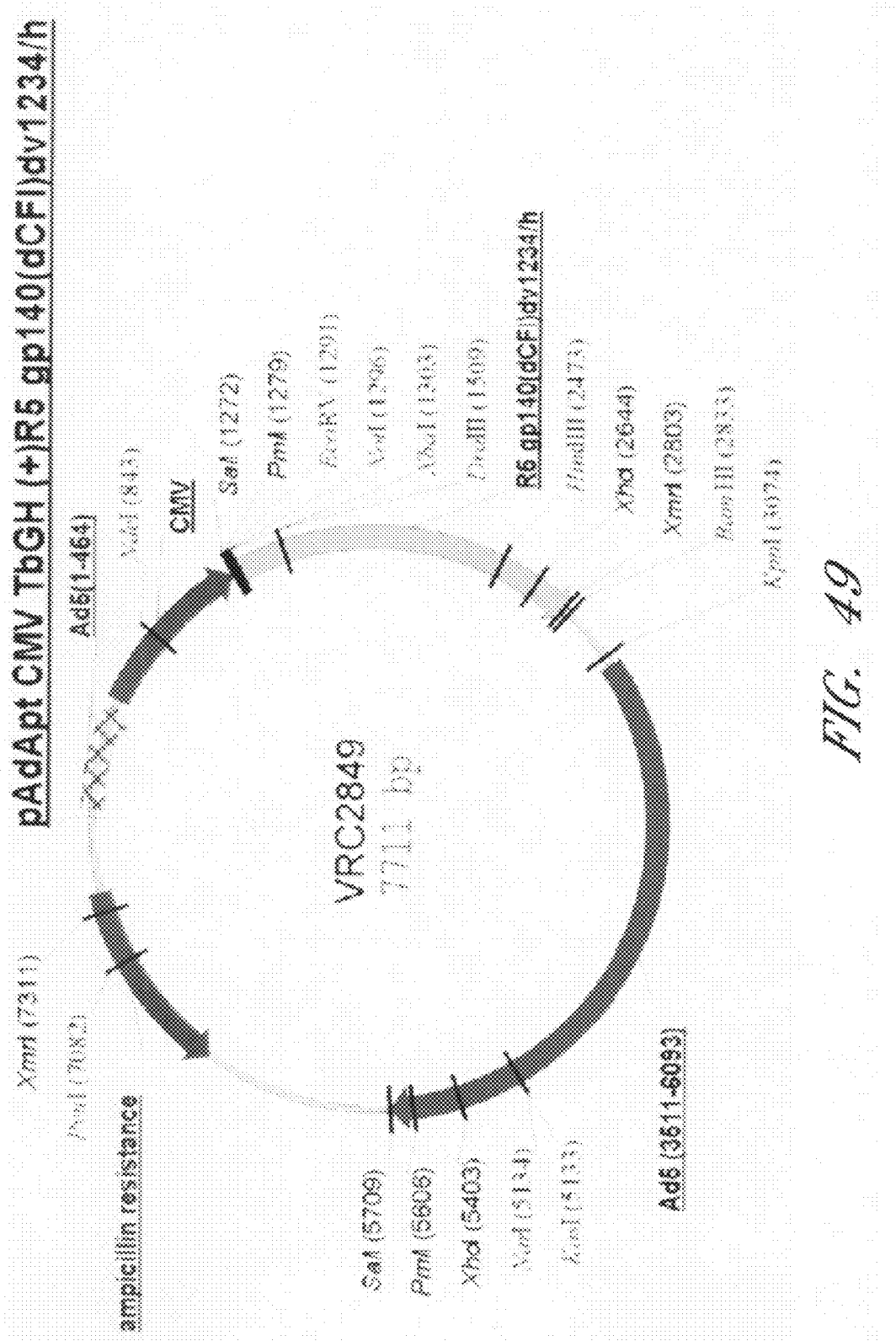
FIG. 49. Plasmid 2849.
Figure 50:
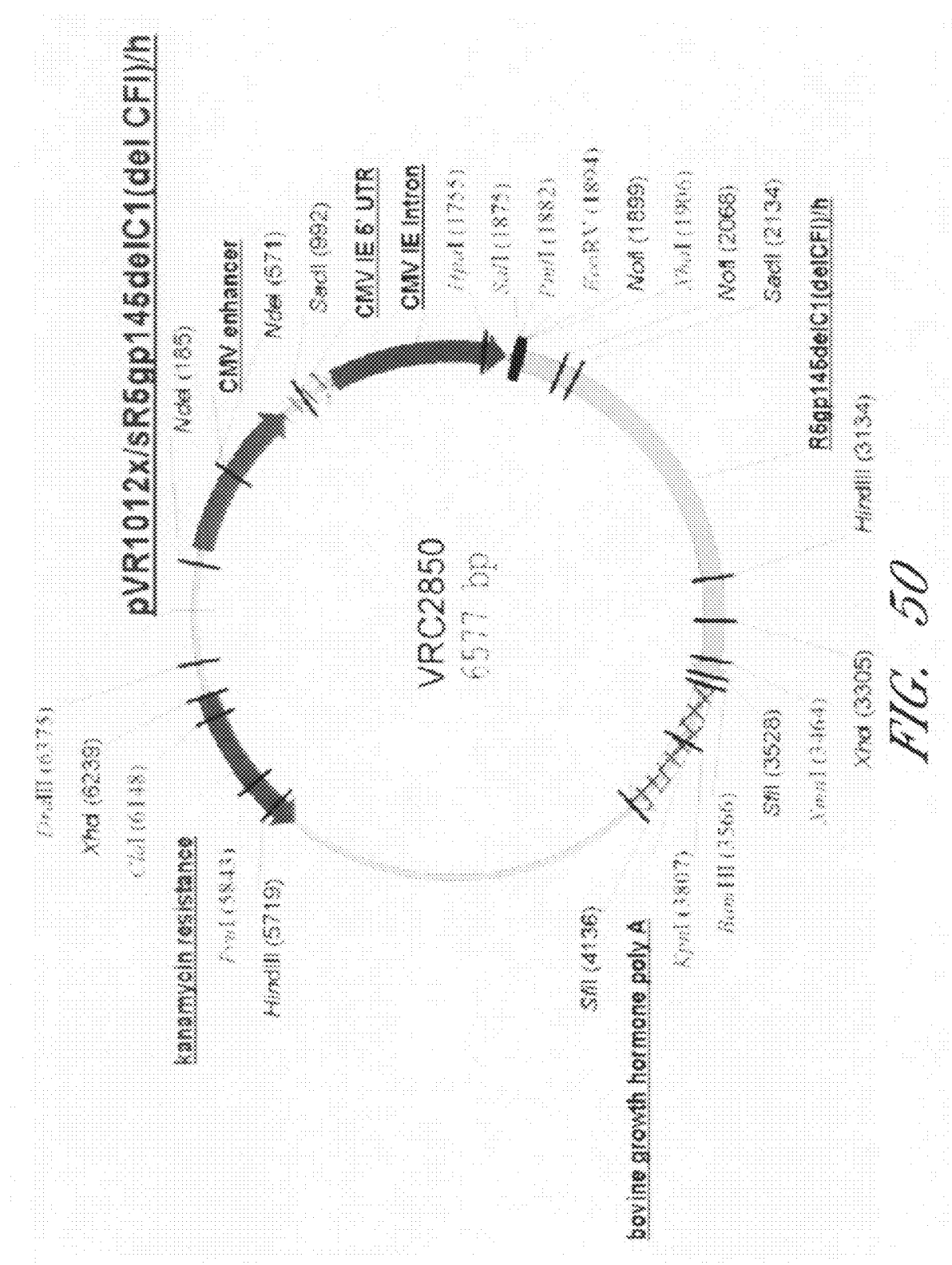
FIG. 50. Plasmid 2850.
Figure 51:
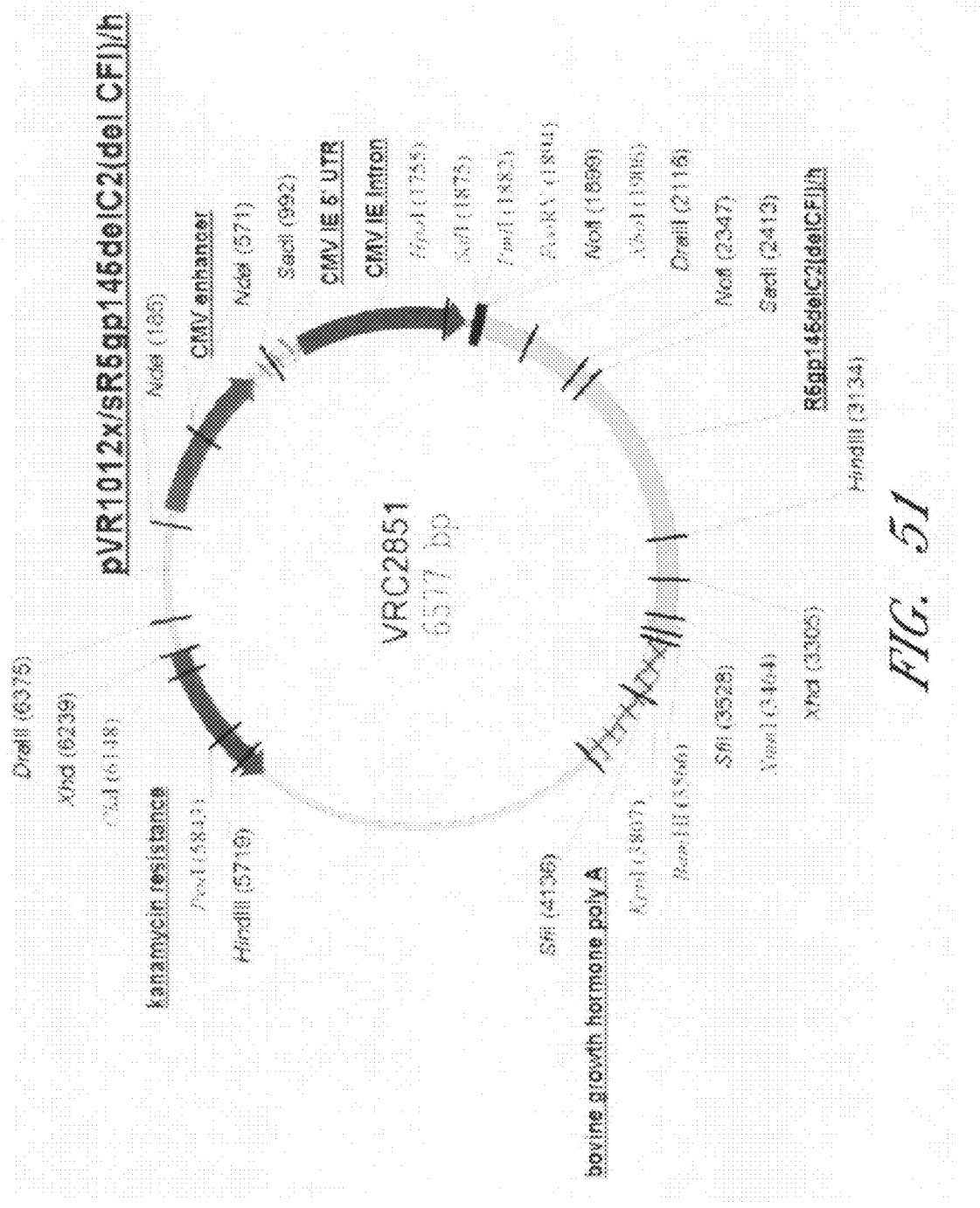
FIG. 51. Plasmid 2851.
Figure 52:
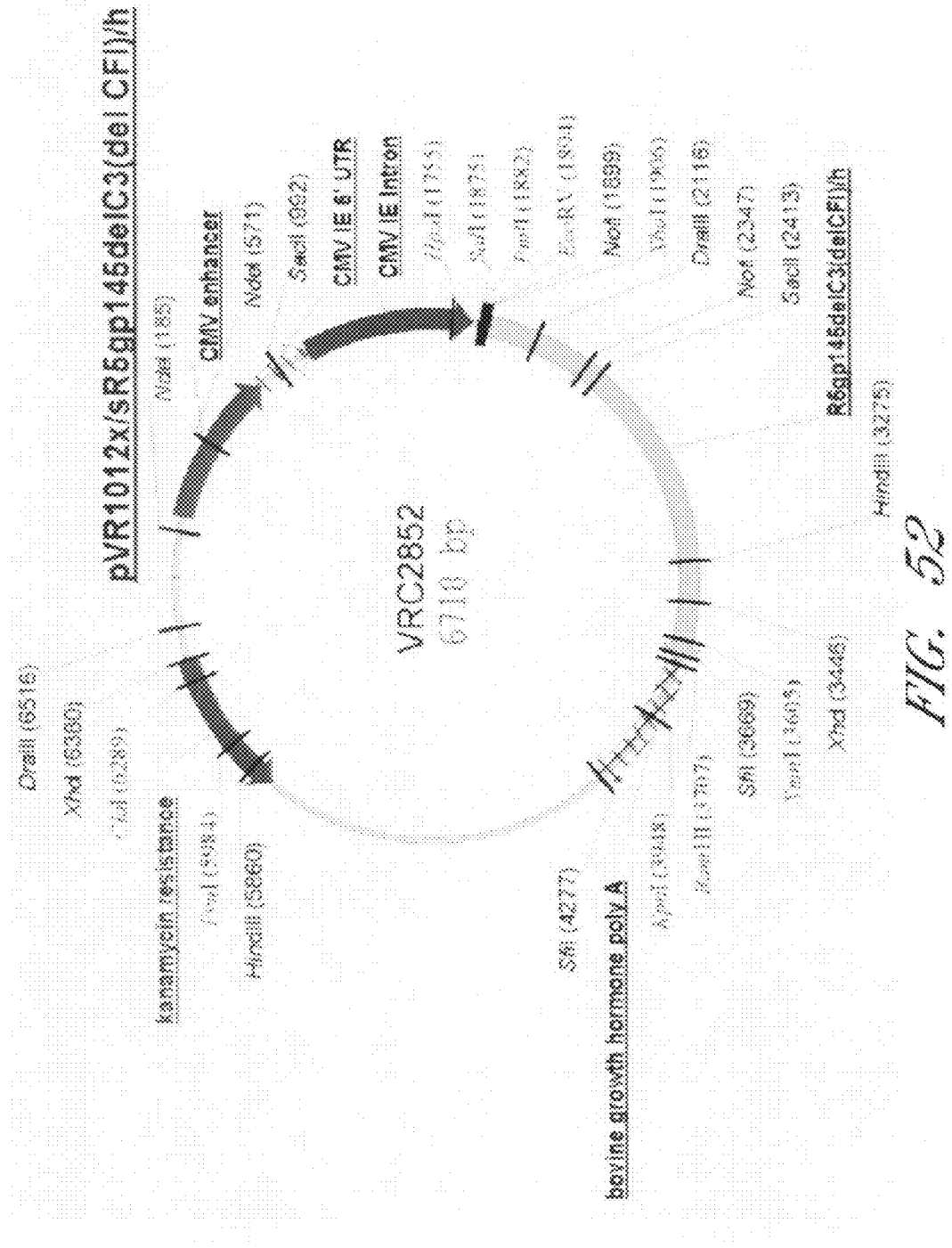
FIG. 52. Plasmid 2852.
Figure 53:
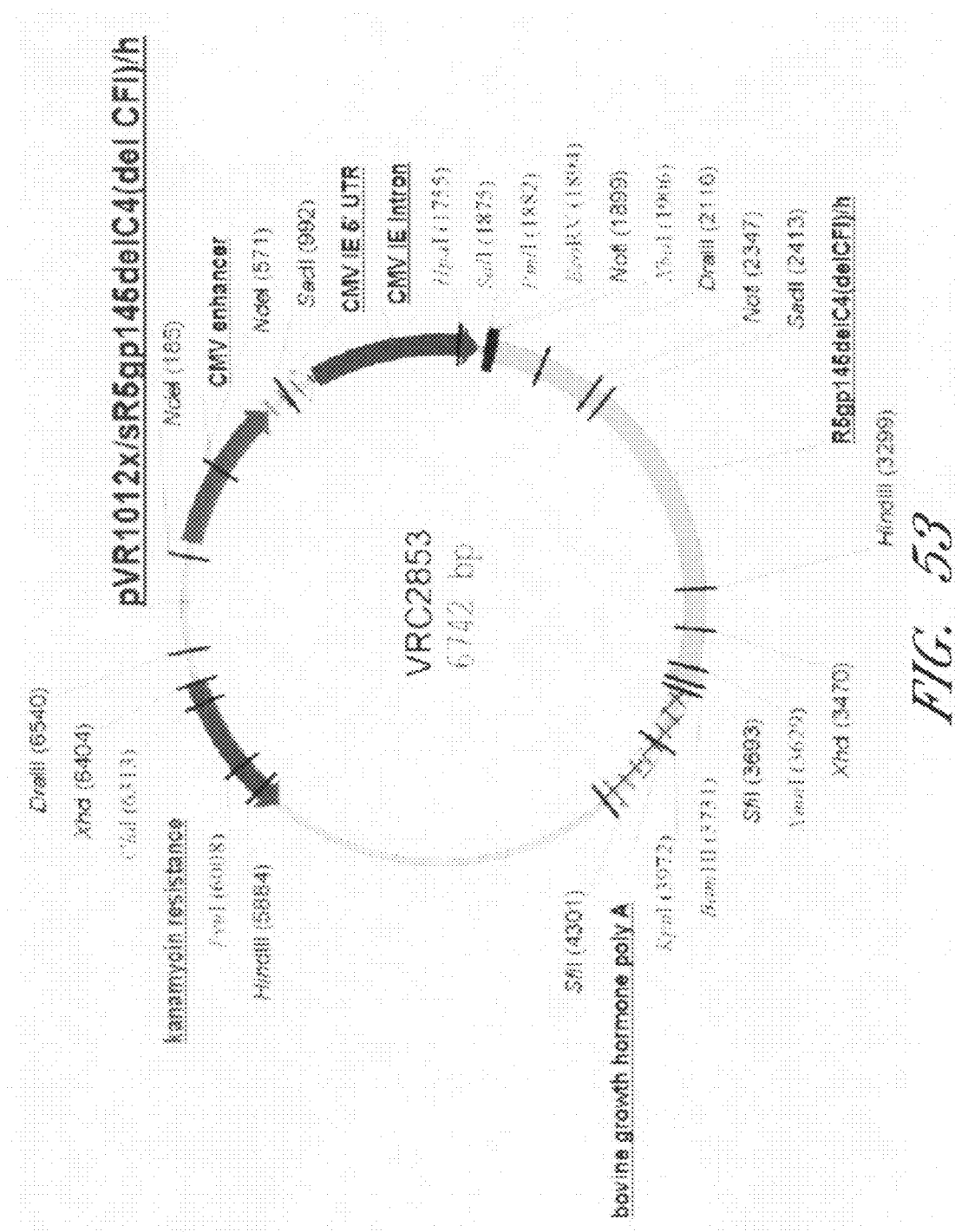
FIG. 53. Plasmid 2853.
Figure 54:
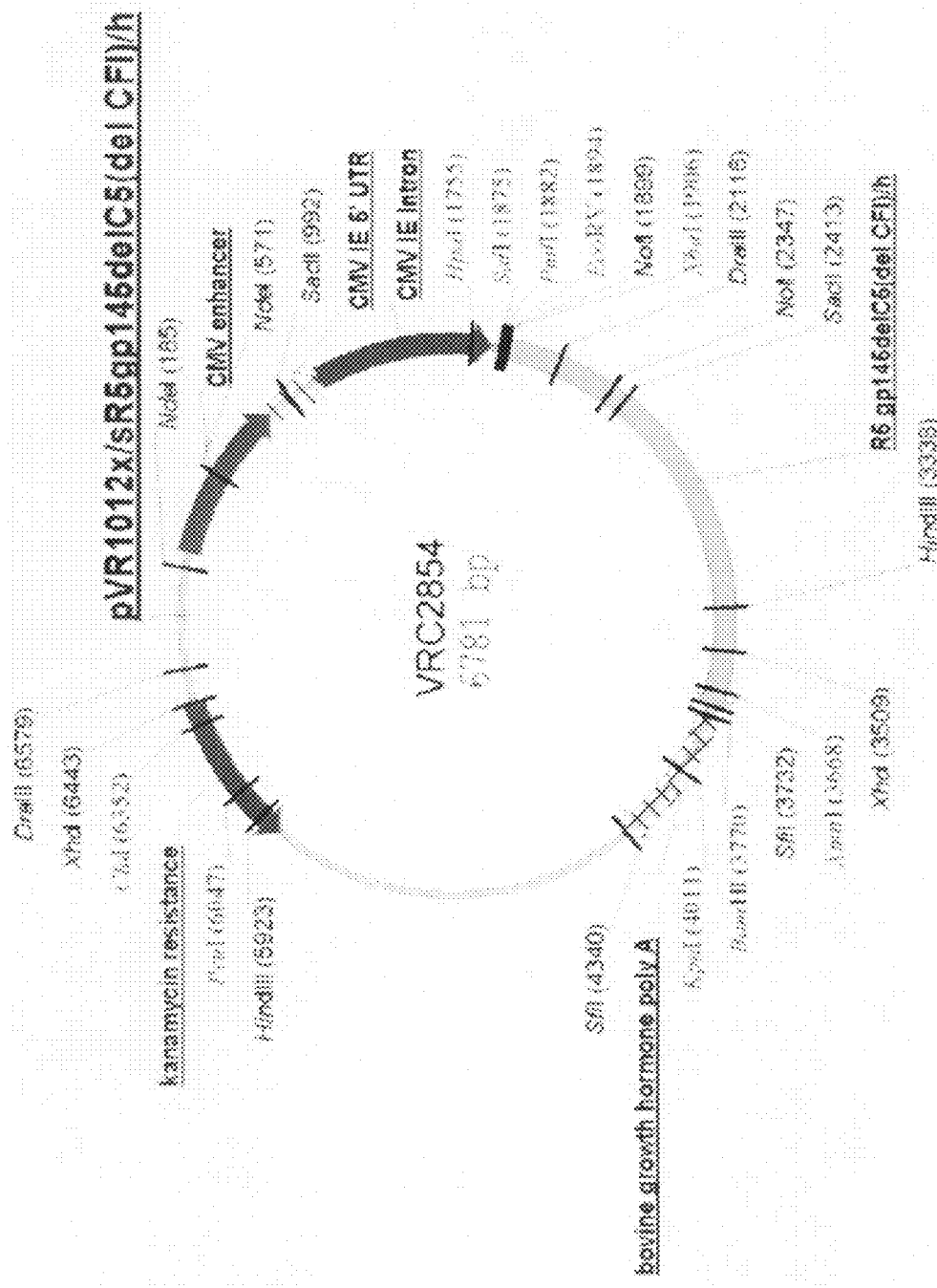
FIG. 54. Plasmid 2854.
Figure 55:
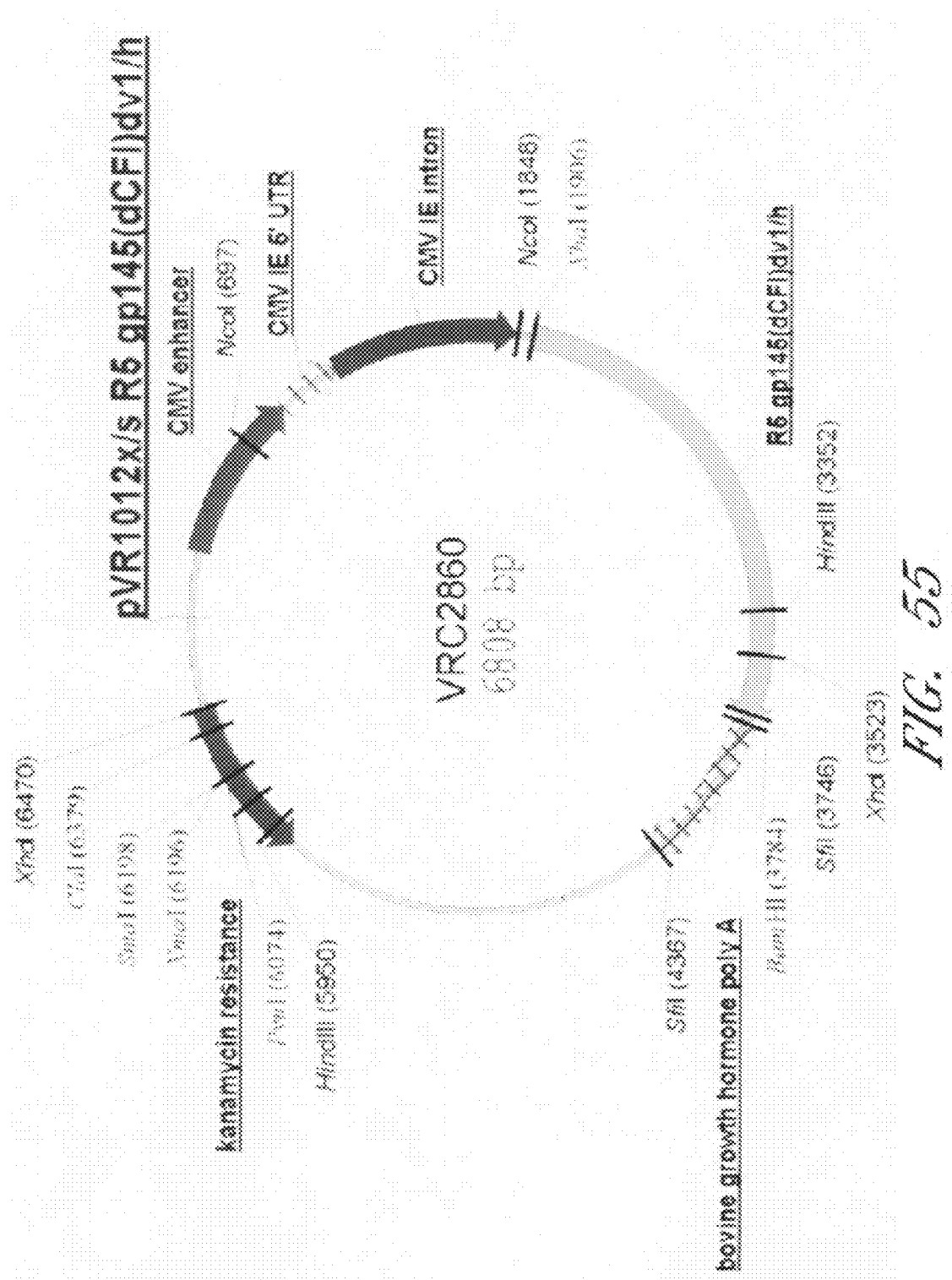
FIG. 55. Plasmid 2860.
Figure 56:
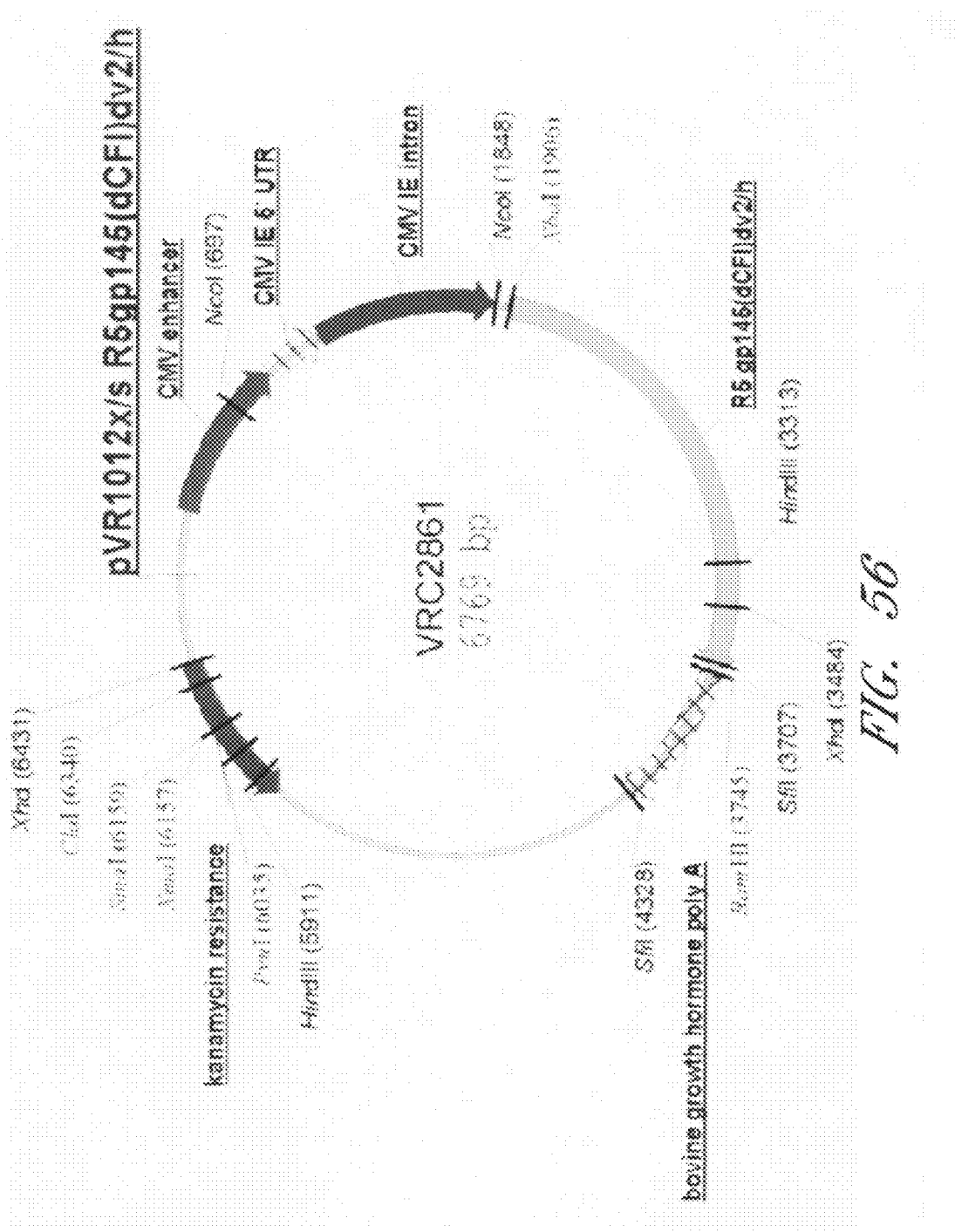
FIG. 56. Plasmid 2861.
Figure 57:
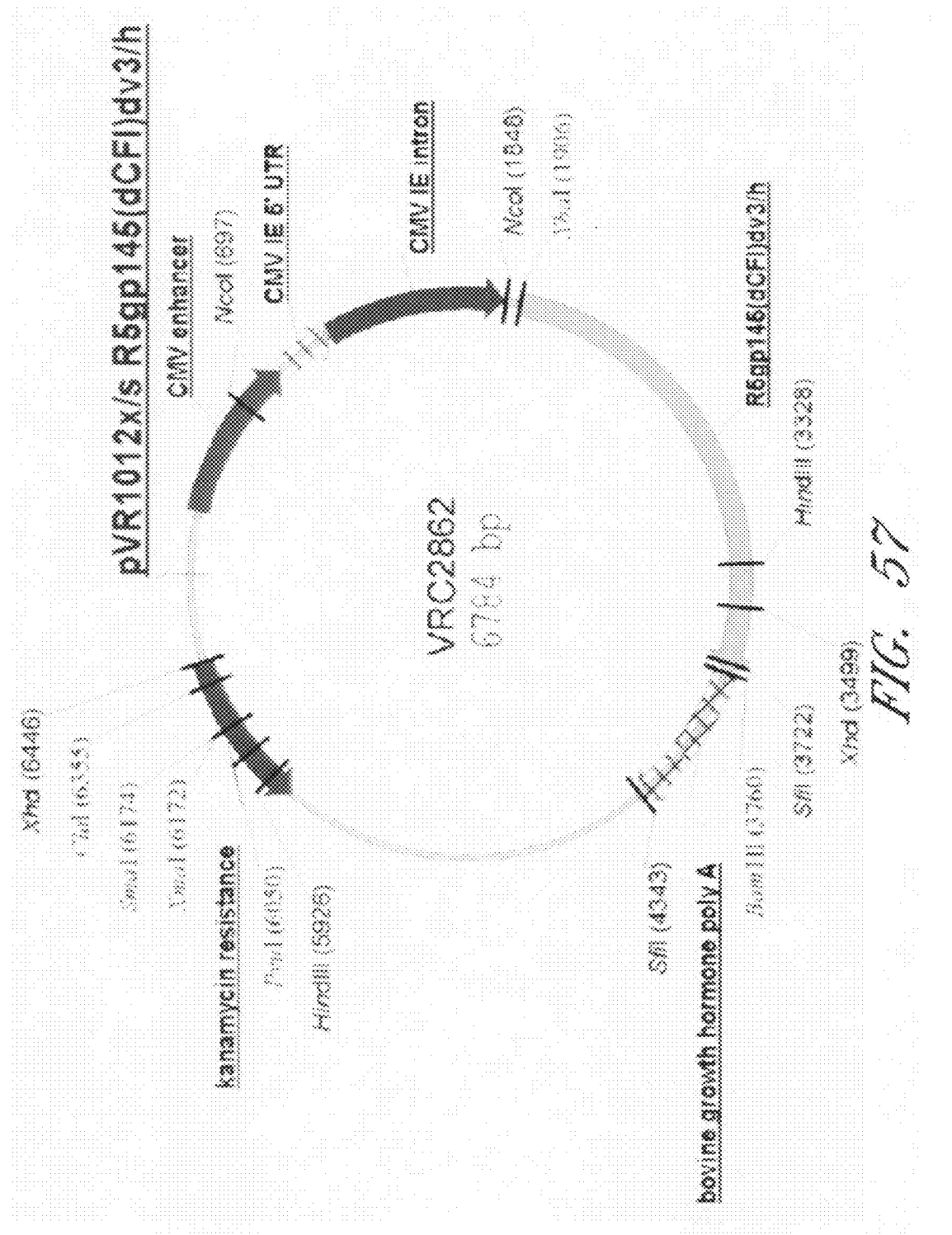
FIG. 57. Plasmid 2862.
Figure 58:
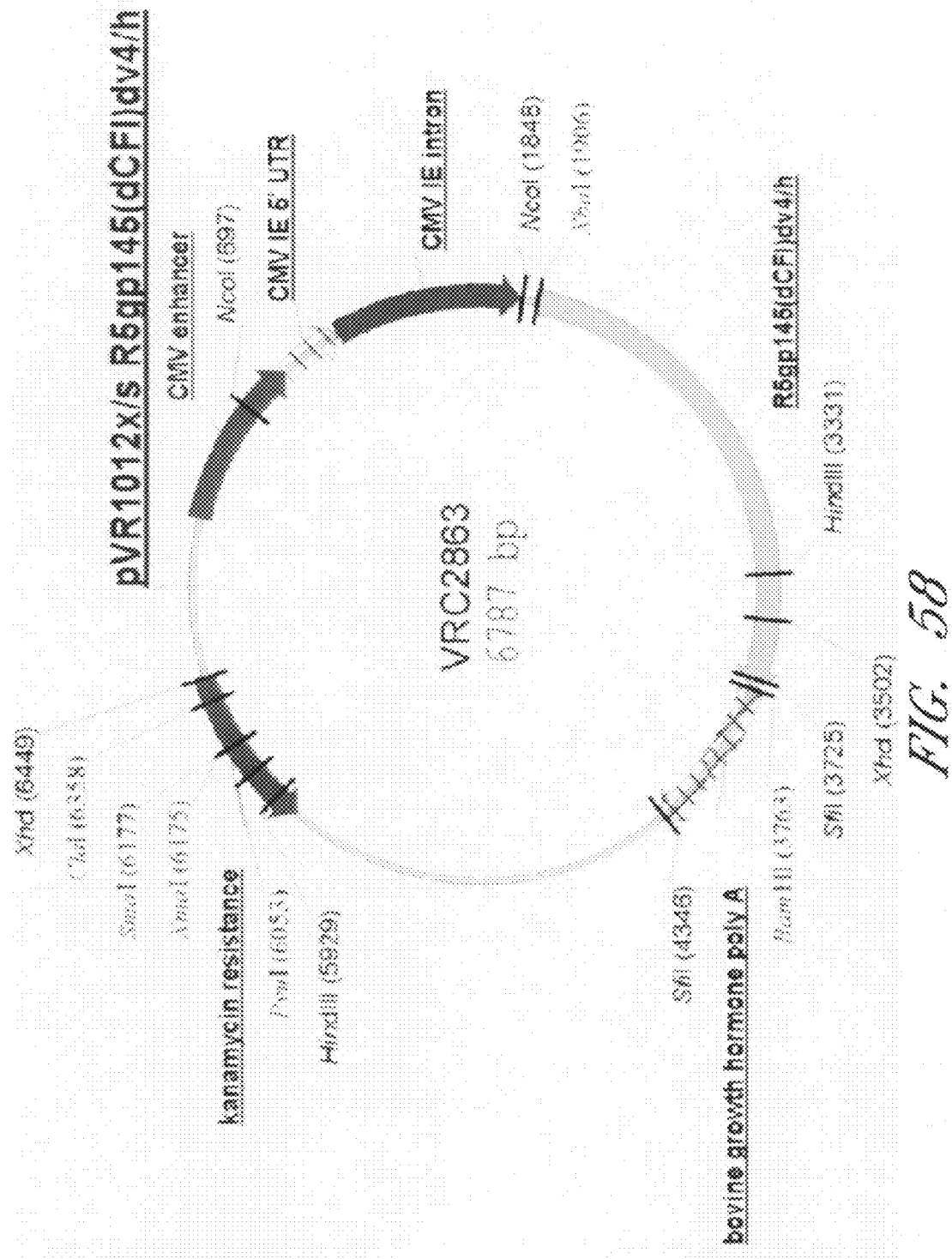
FIG. 58. Plasmid 2863.
Figure 59:
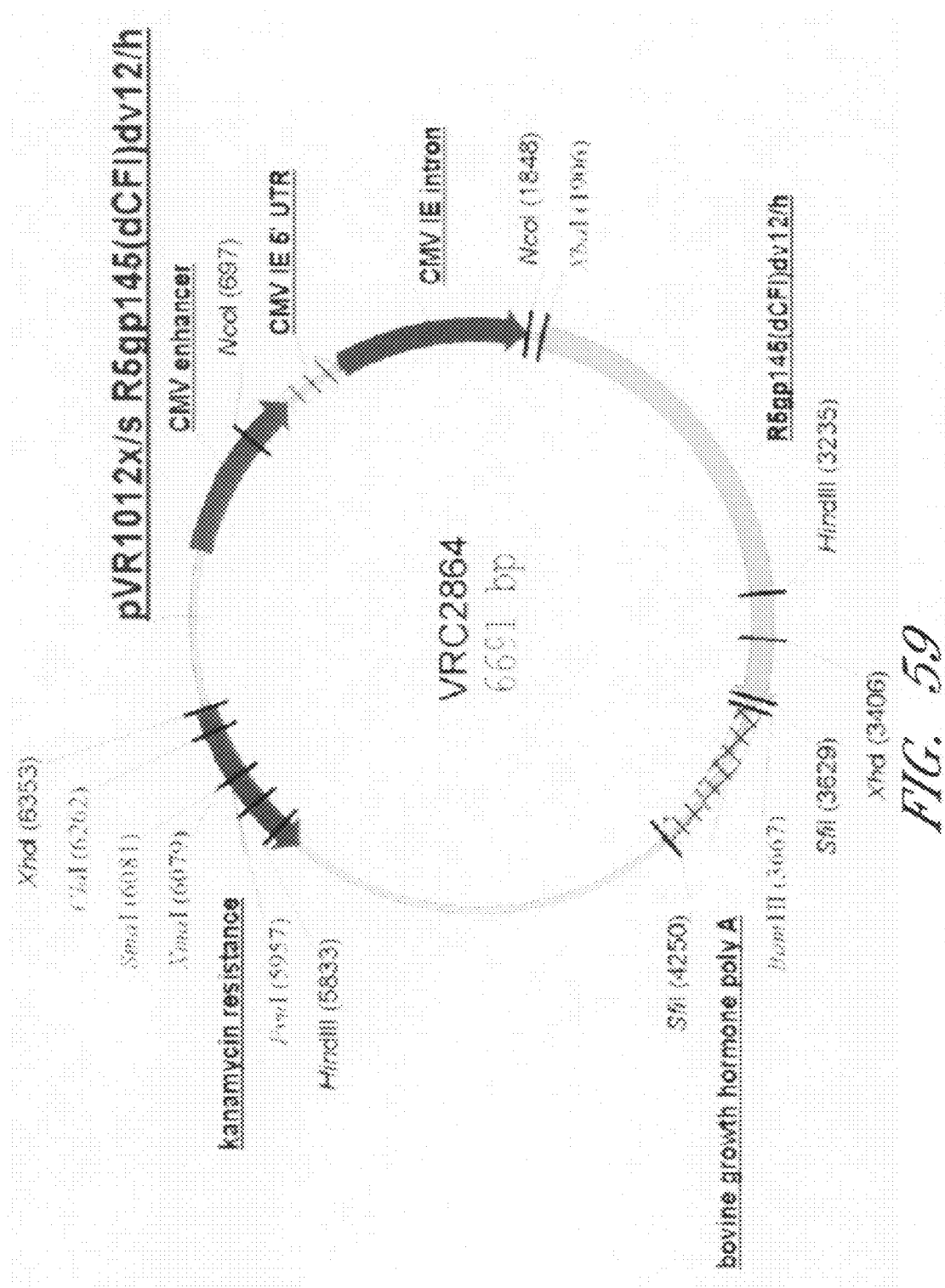
FIG. 59. Plasmid 2864.
Figure 60:
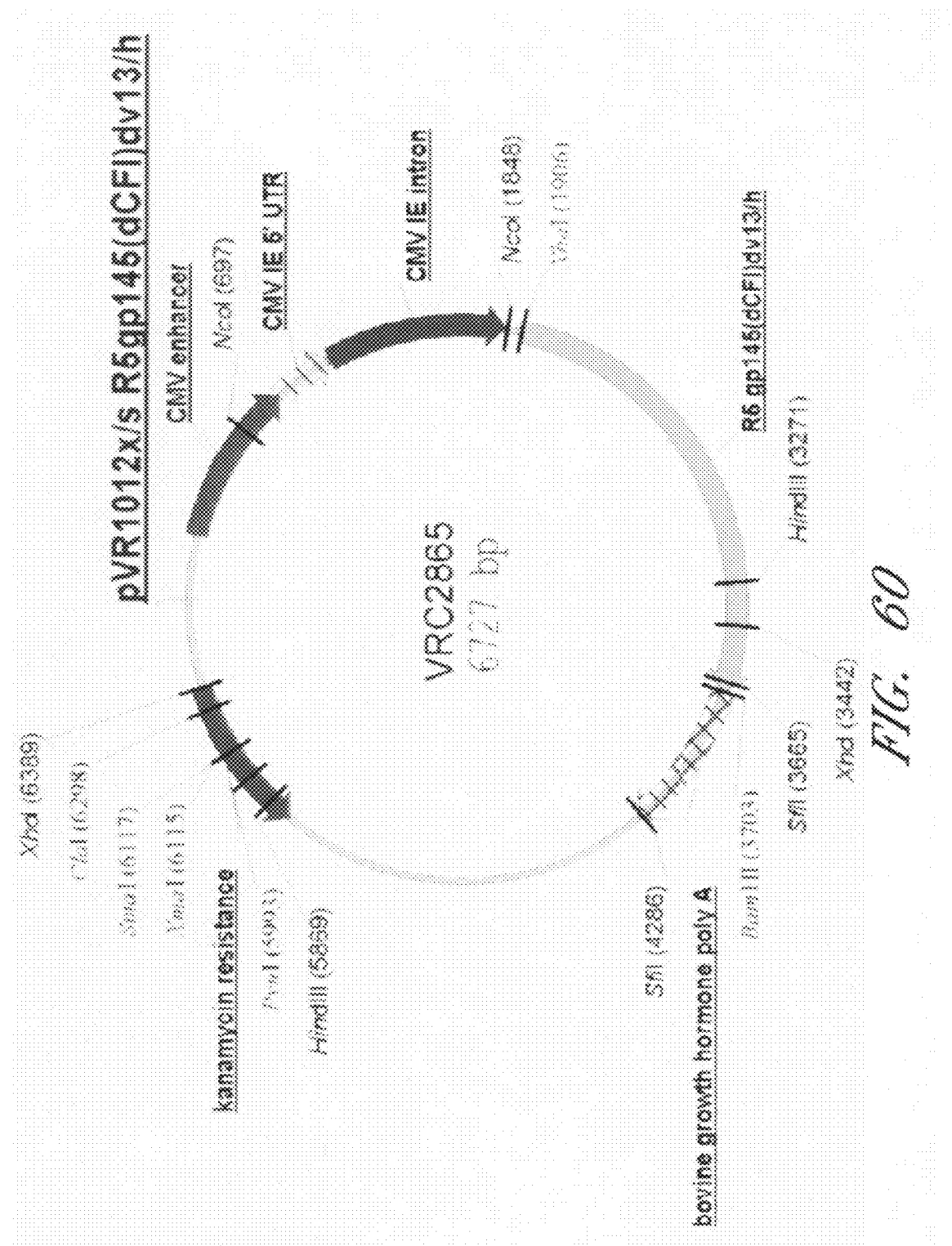
FIG. 60. Plasmid 2865.
Figure 61:
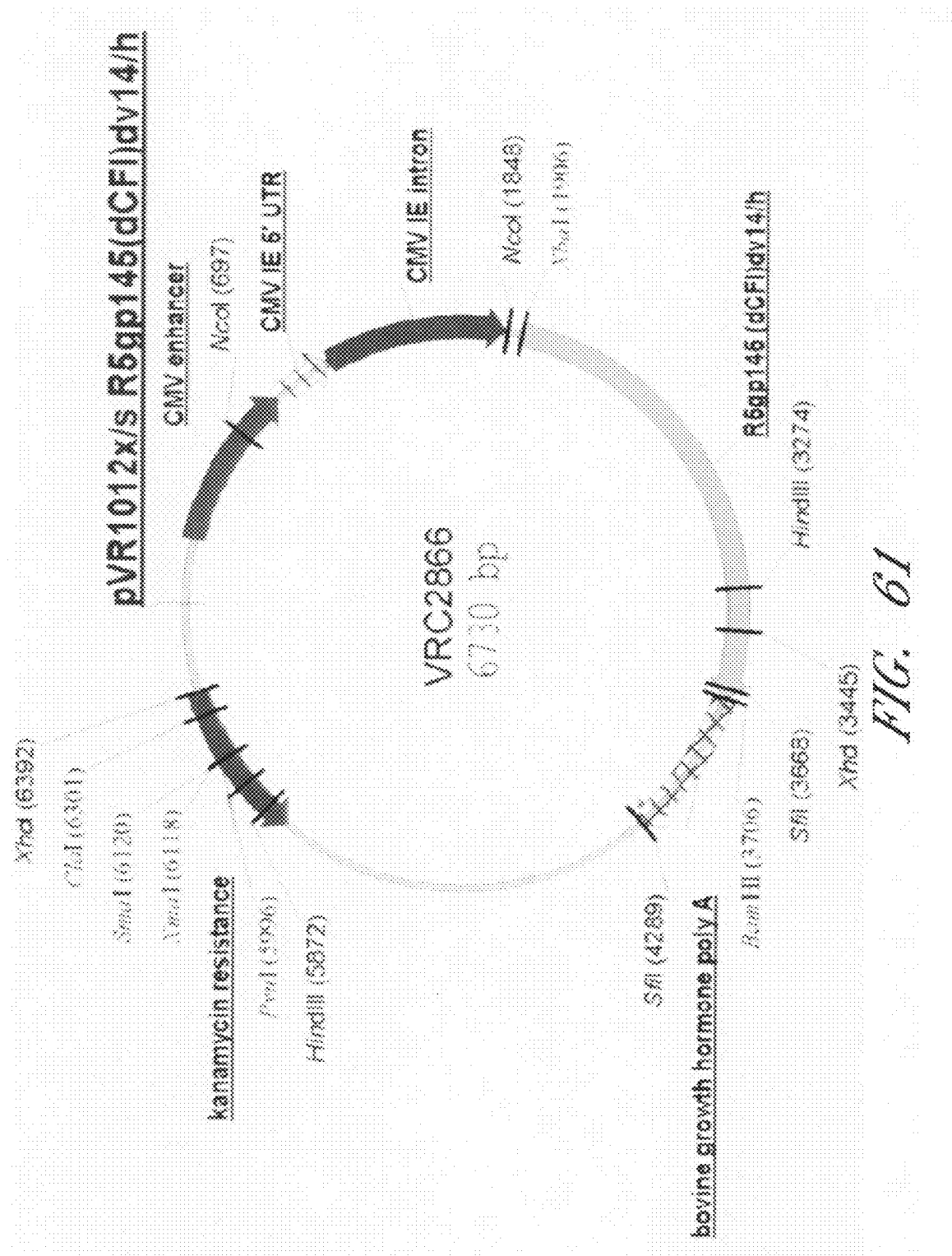
FIG. 61. Plasmid 2866.
Figure 62:
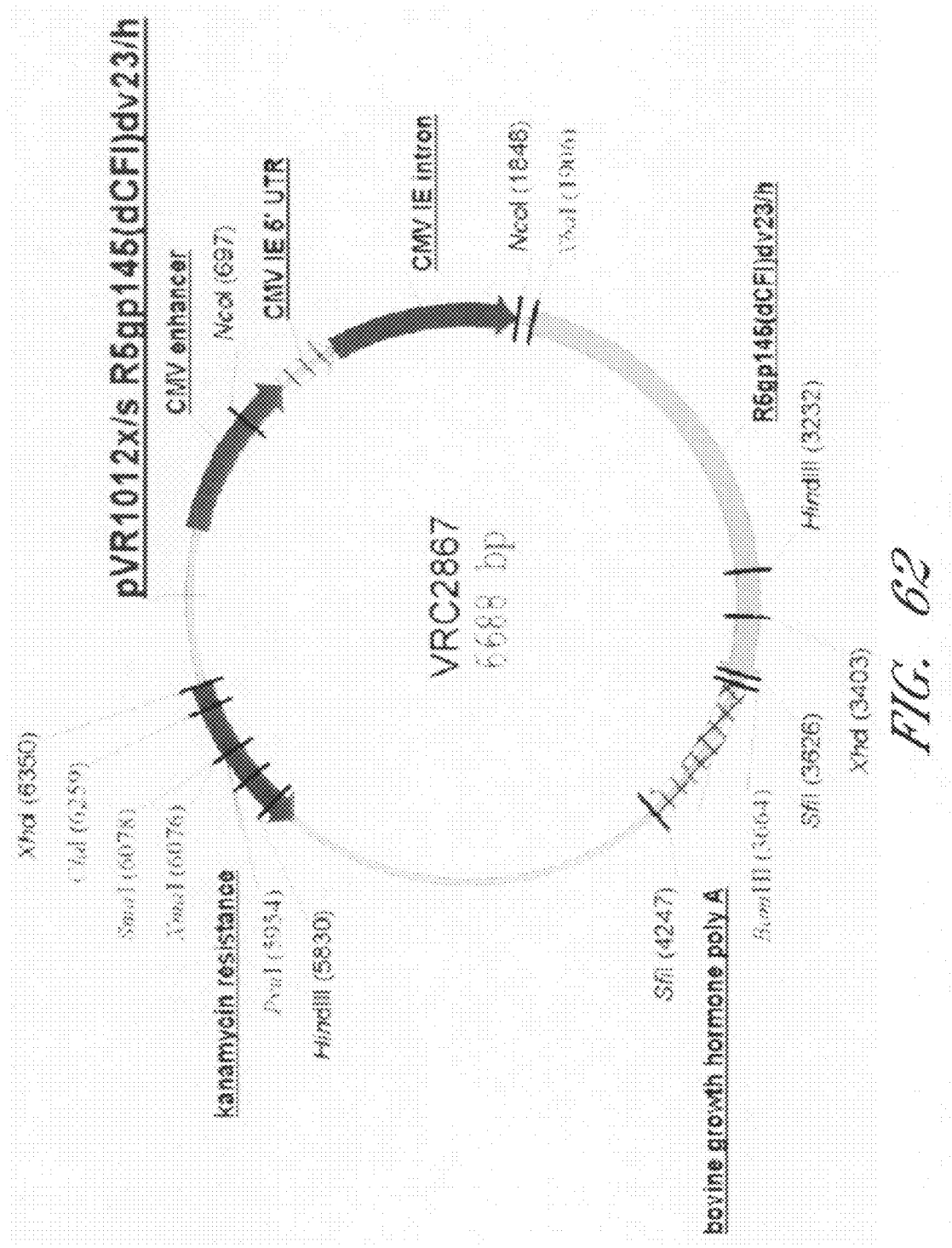
FIG. 62. Plasmid 2867.
Figure 63:
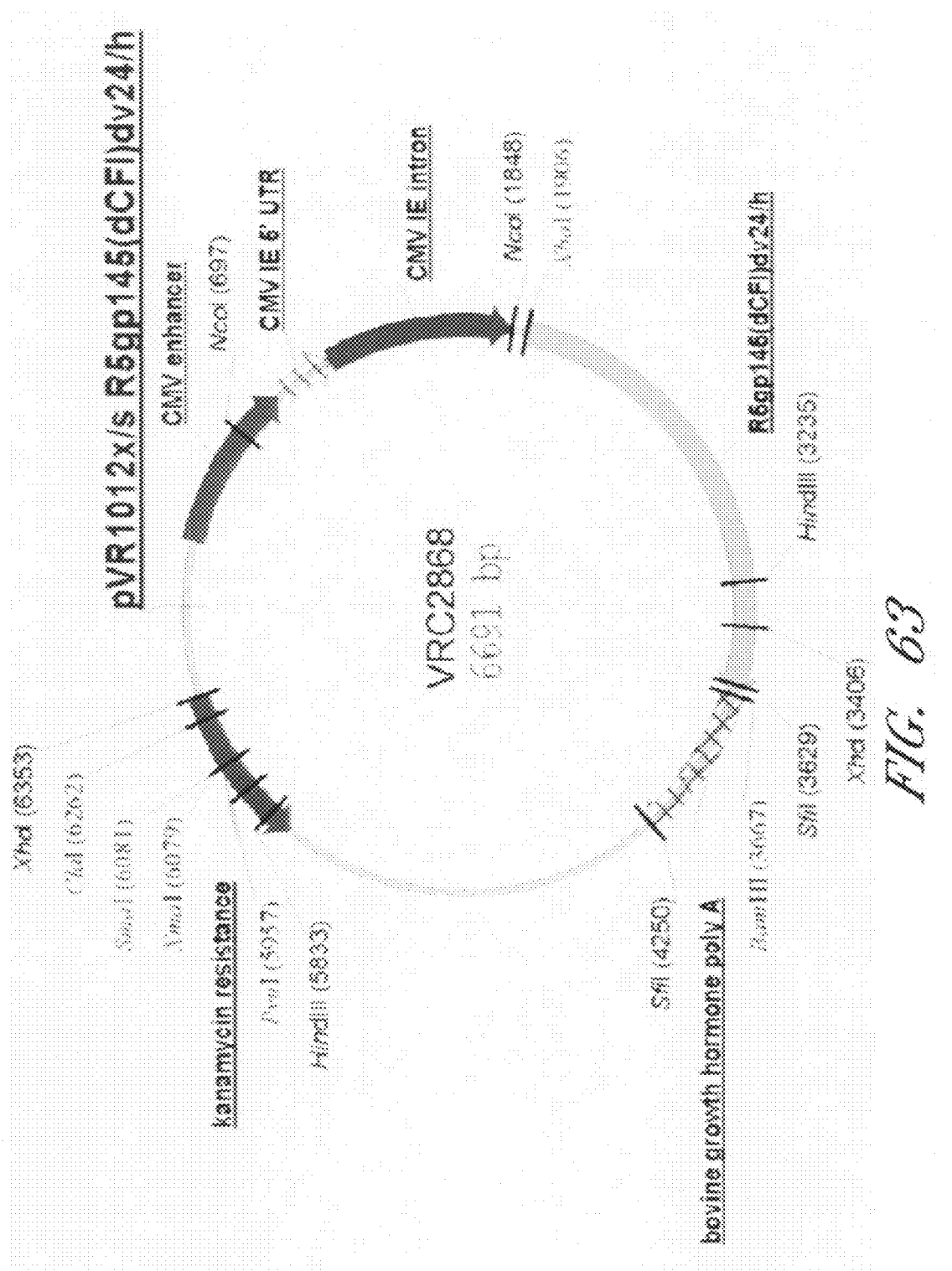
FIG. 63. Plasmid 2868.
Figure 64:
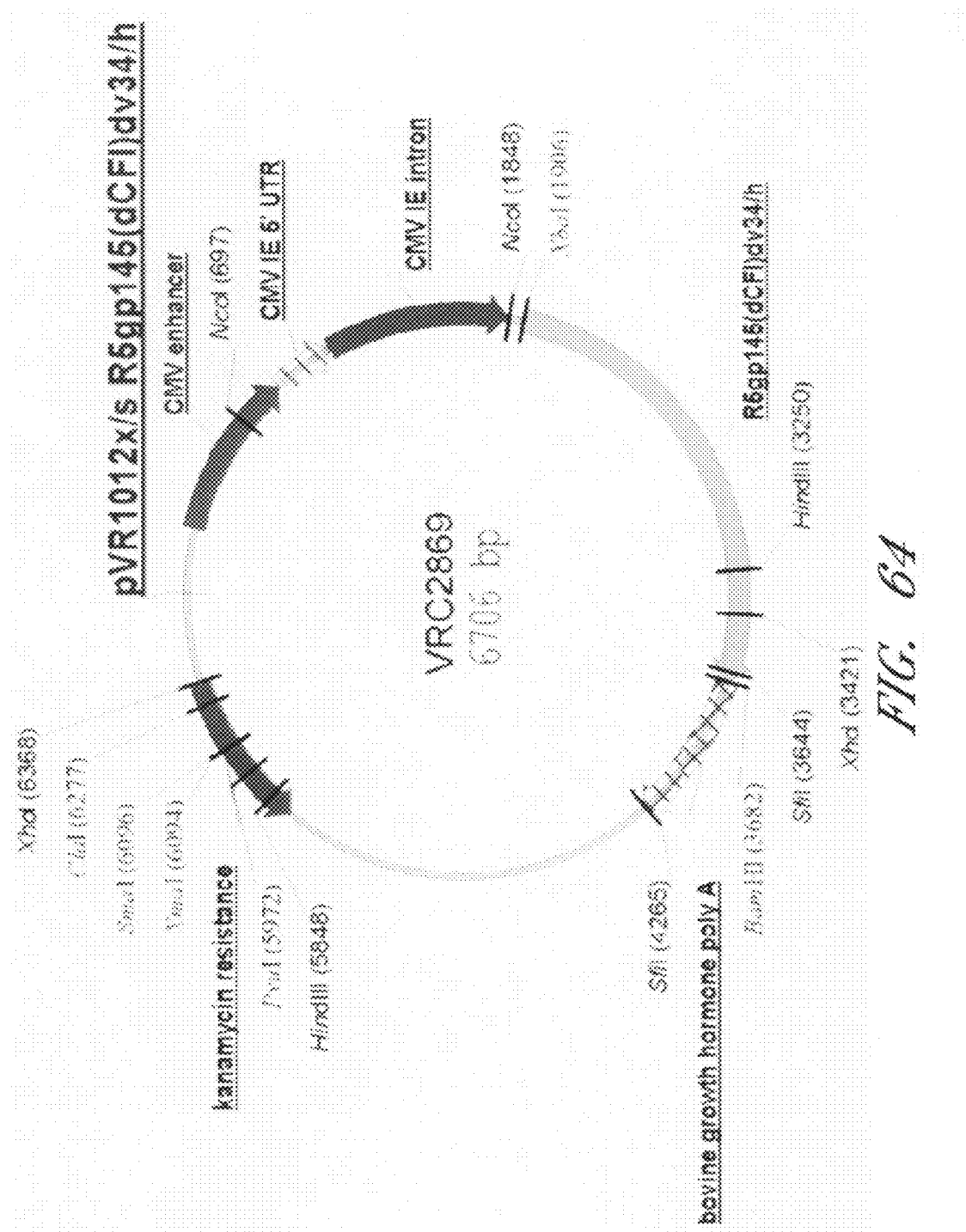
FIG. 64. Plasmid 2869.
Figure 65:
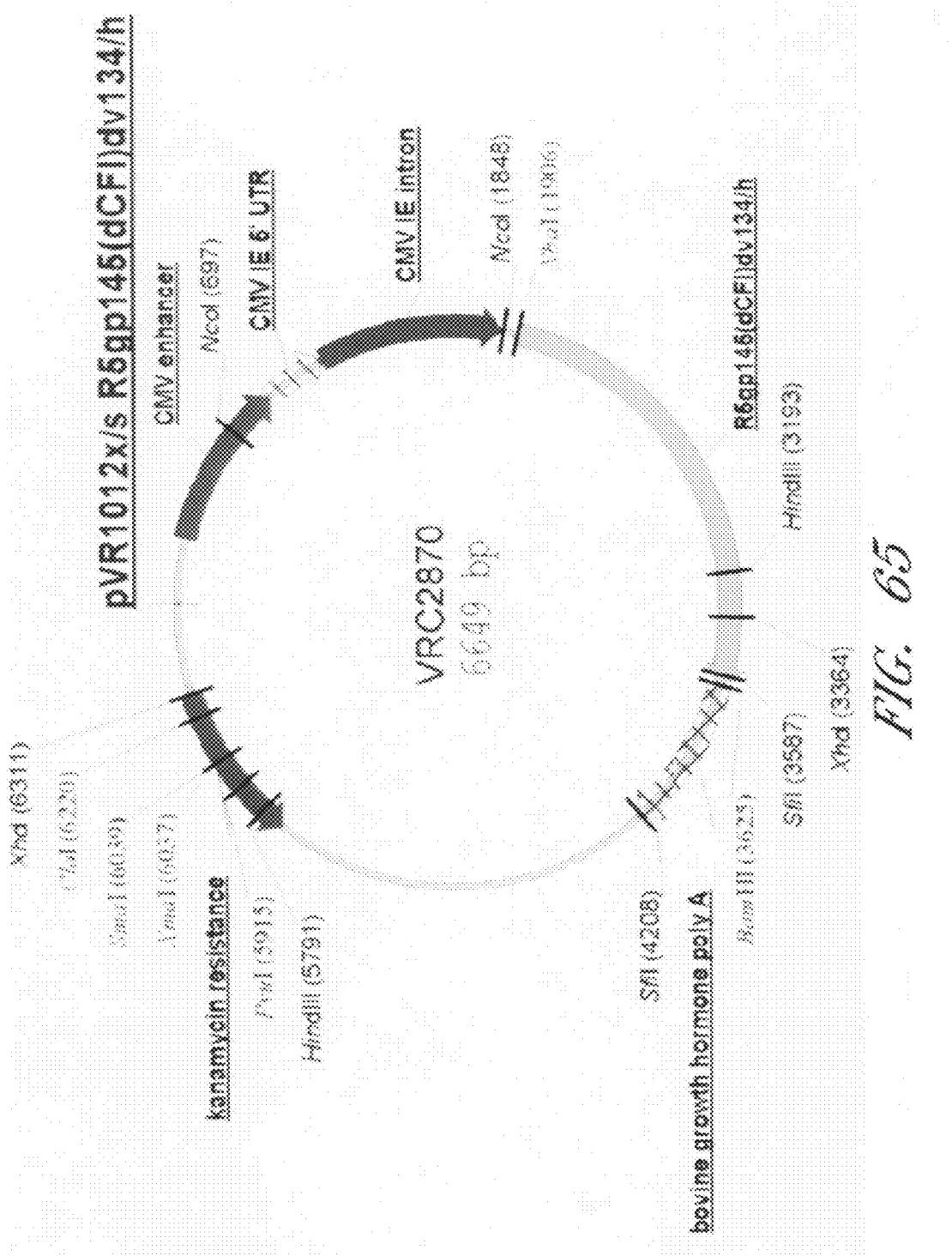
FIG. 65. Plasmid 2870.
Figure 66:
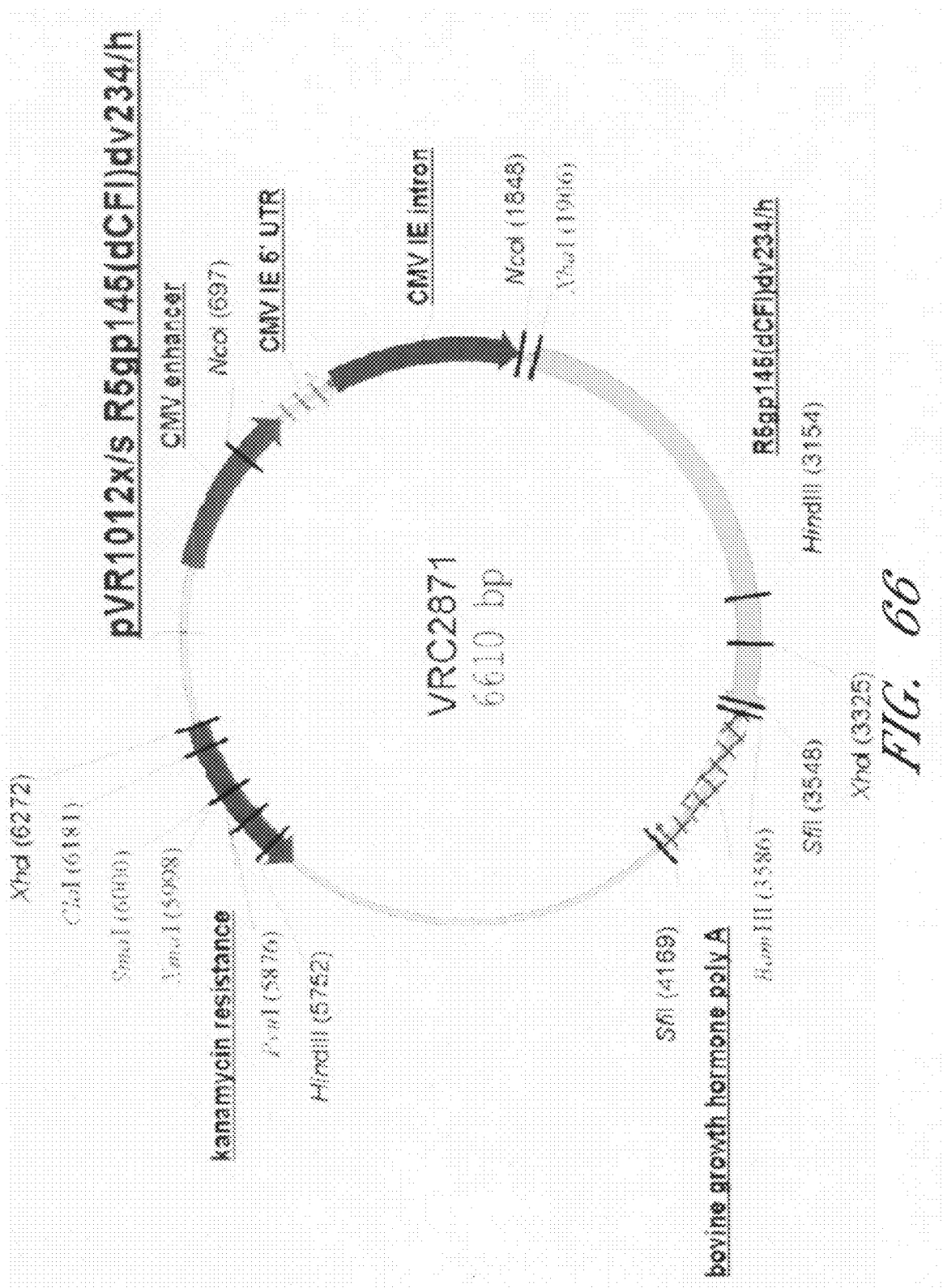
FIG. 66. Plasmid 2871.
Figure 67:
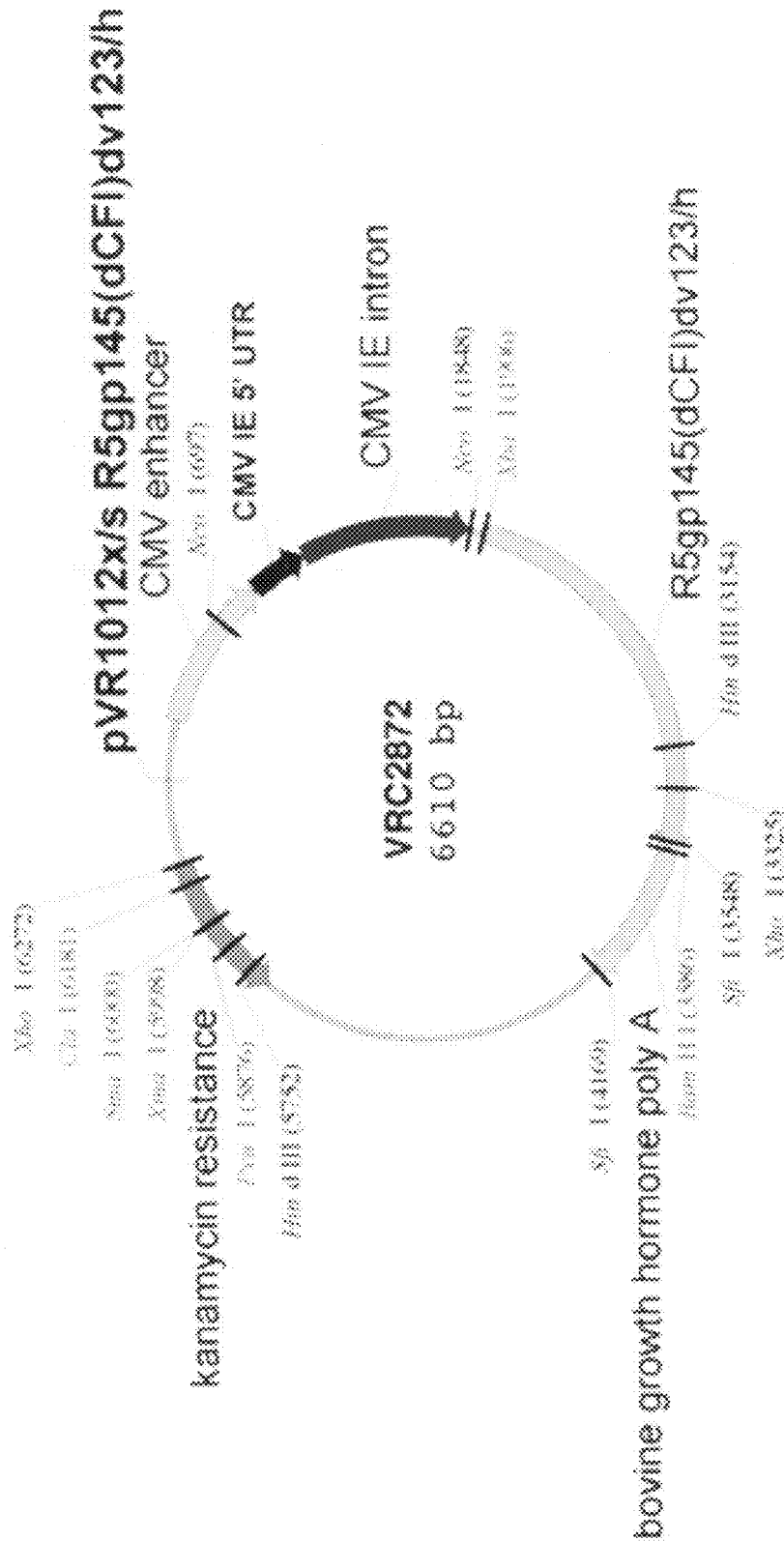
FIG. 67. Plasmid 2872.
Figure 68:
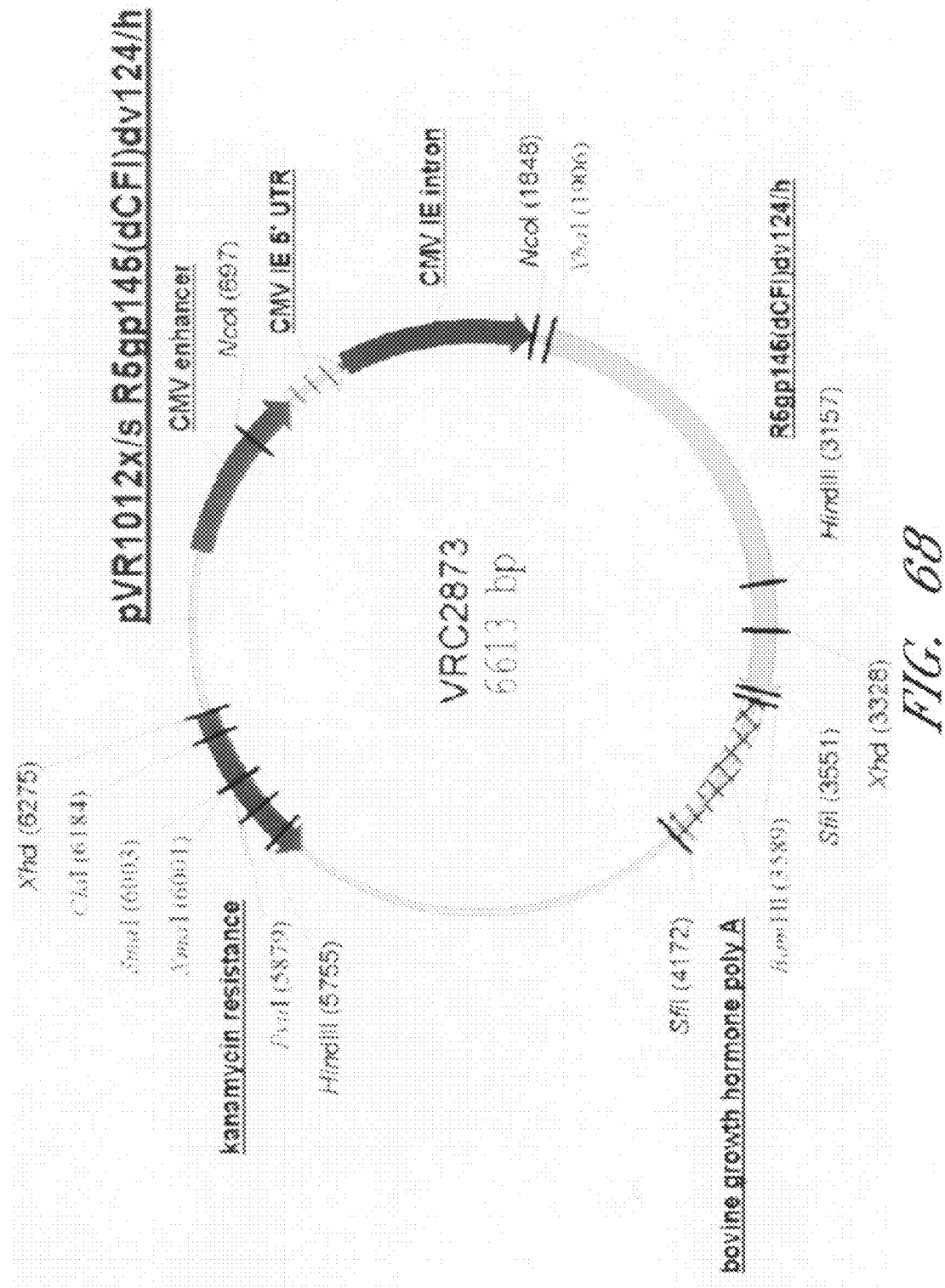
FIG. 68. Plasmid 2873.
Figure 69:
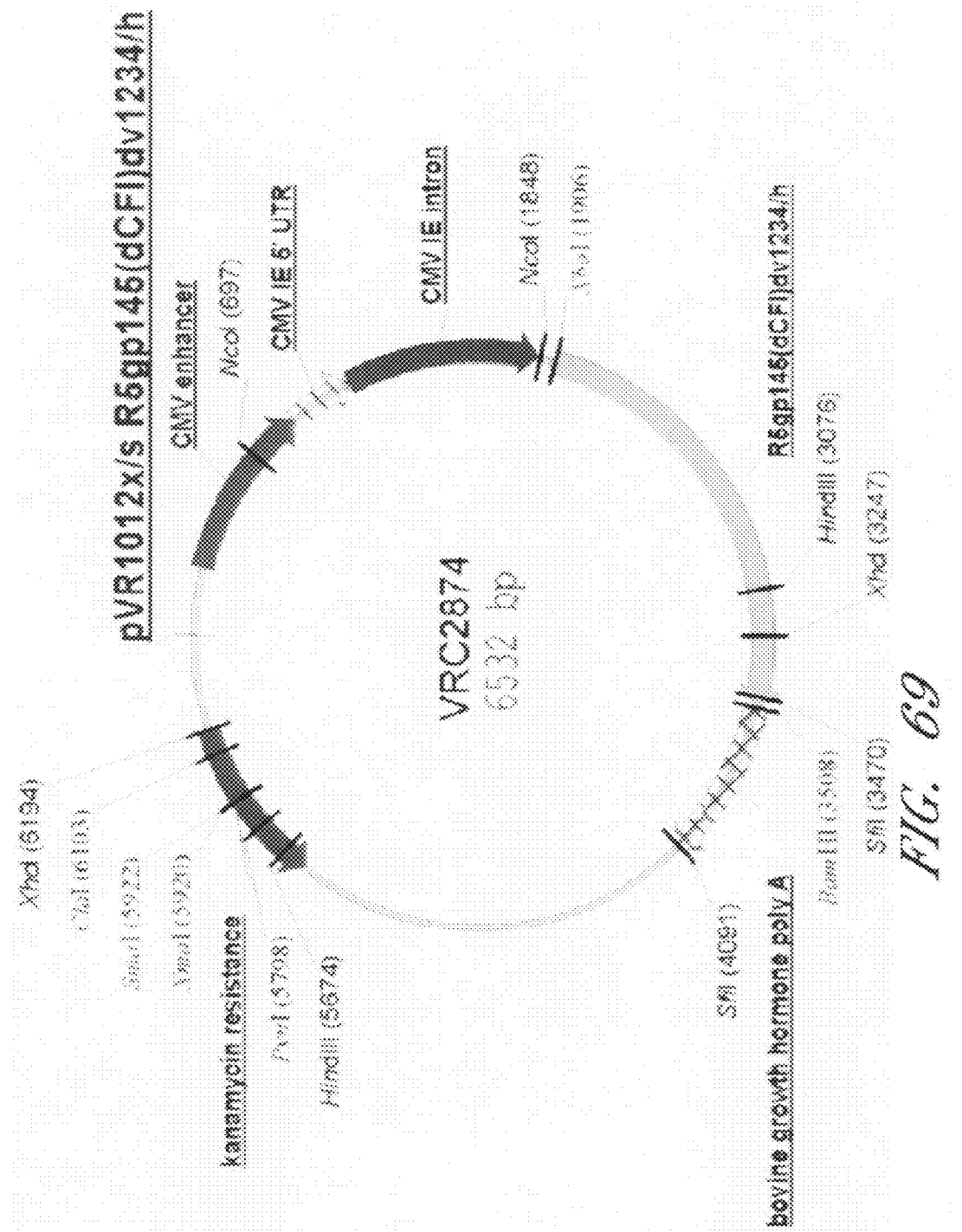
FIG. 69. Plasmid 2874.
Figure 70:
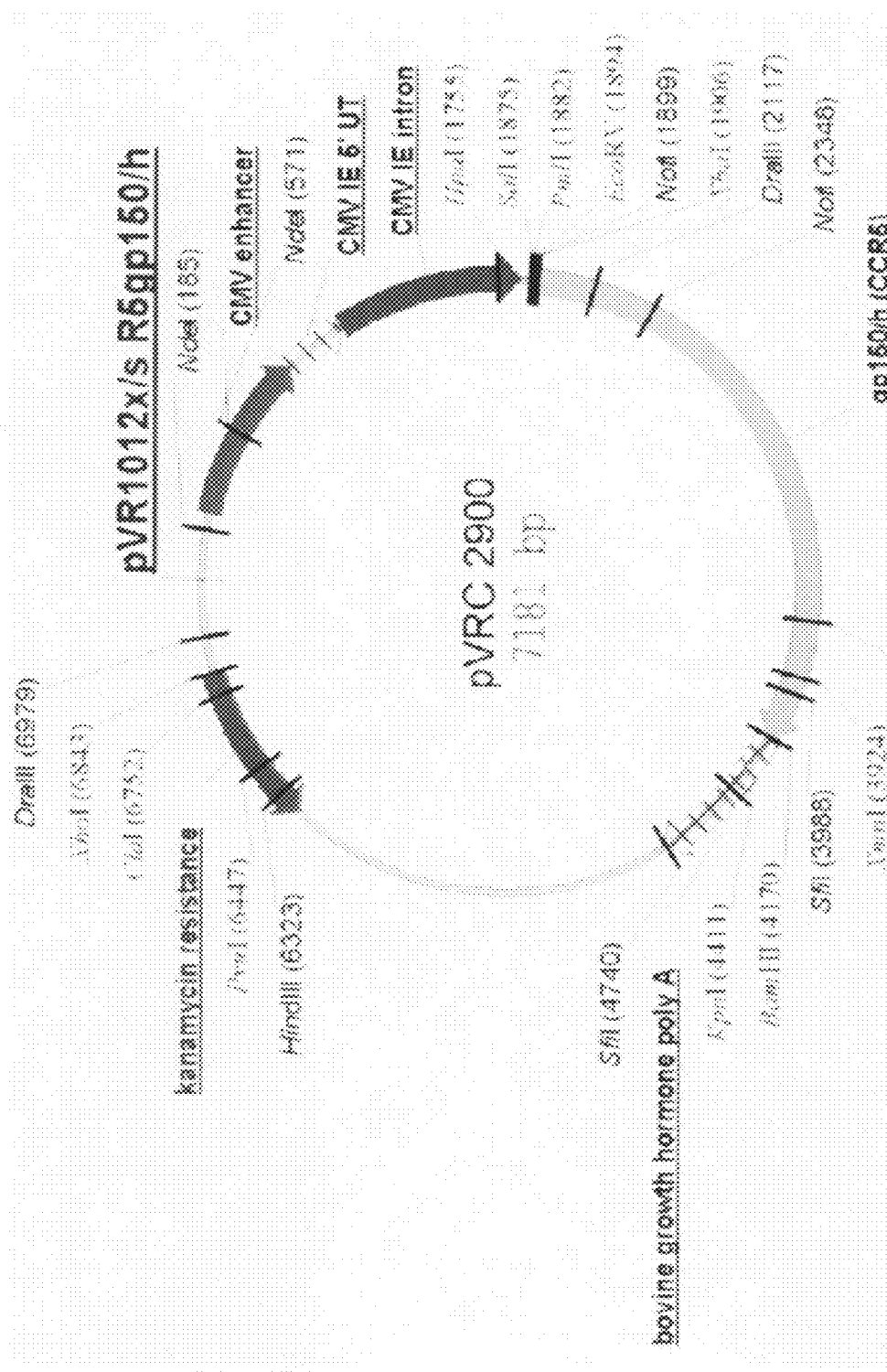
FIG. 70. Plasmid 2900.
Figure 71:
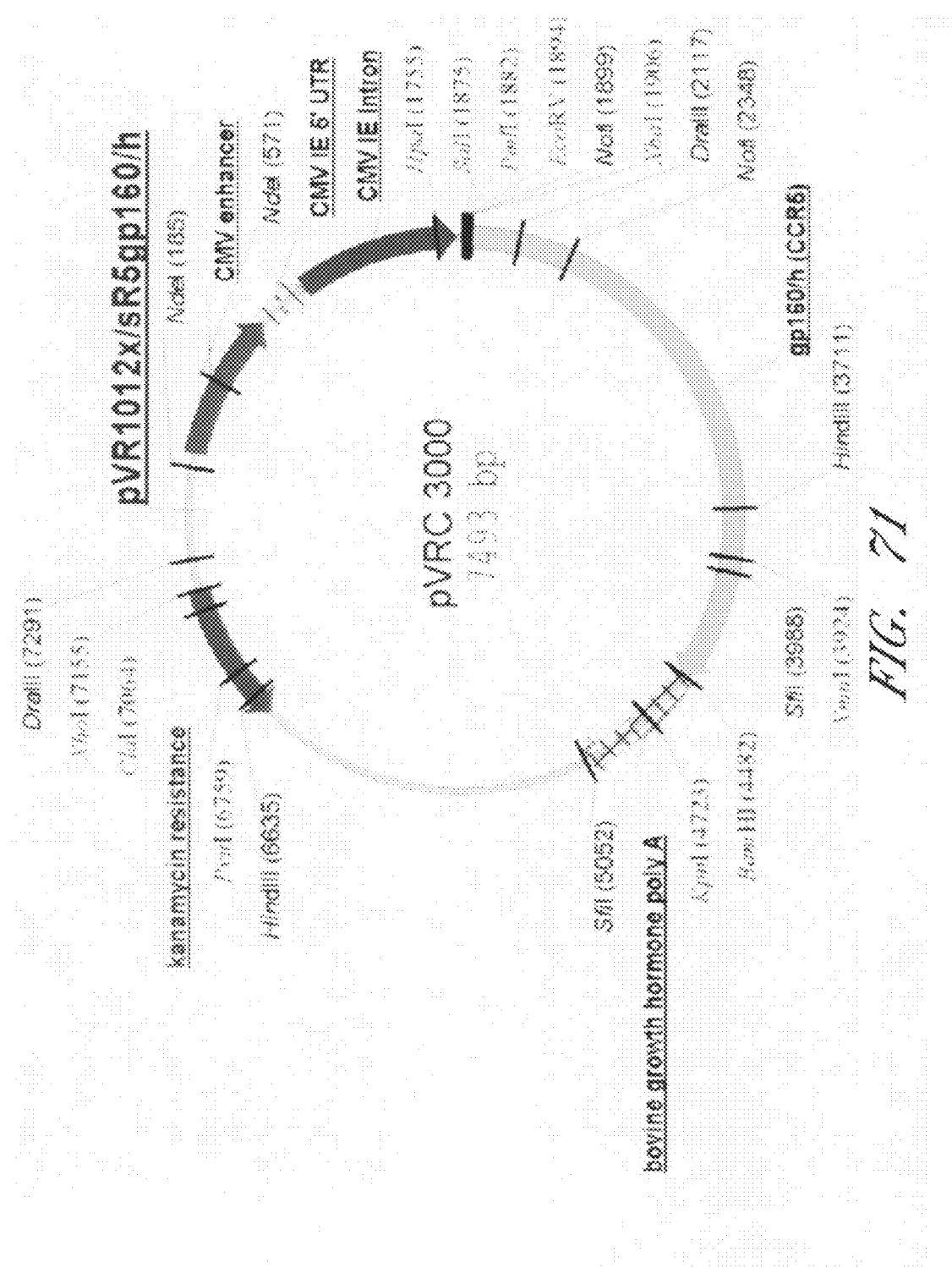
FIG. 71. Plasmid 3000.
Figure 72:
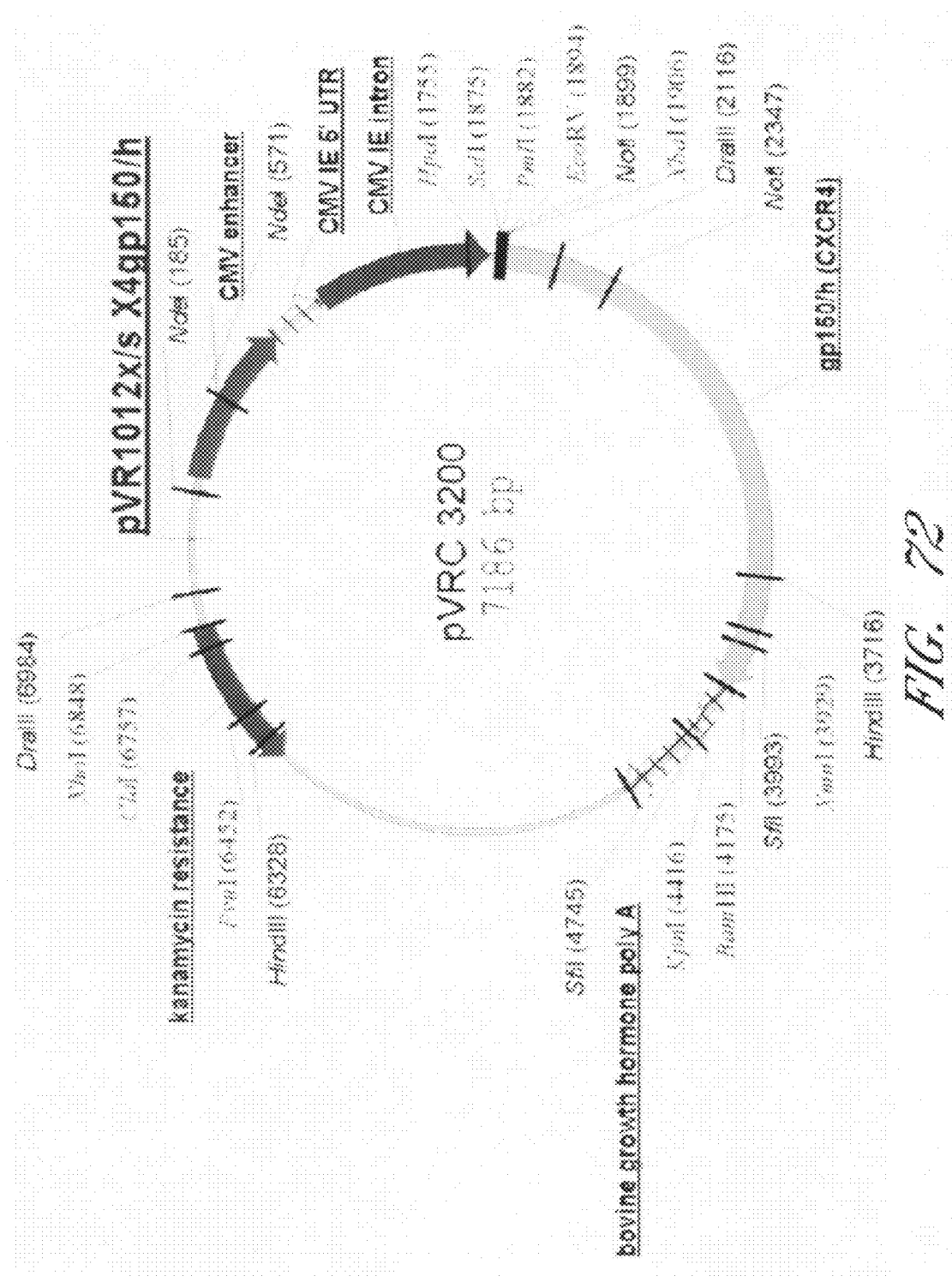
FIG. 72. Plasmid 3200.
Figure 73:
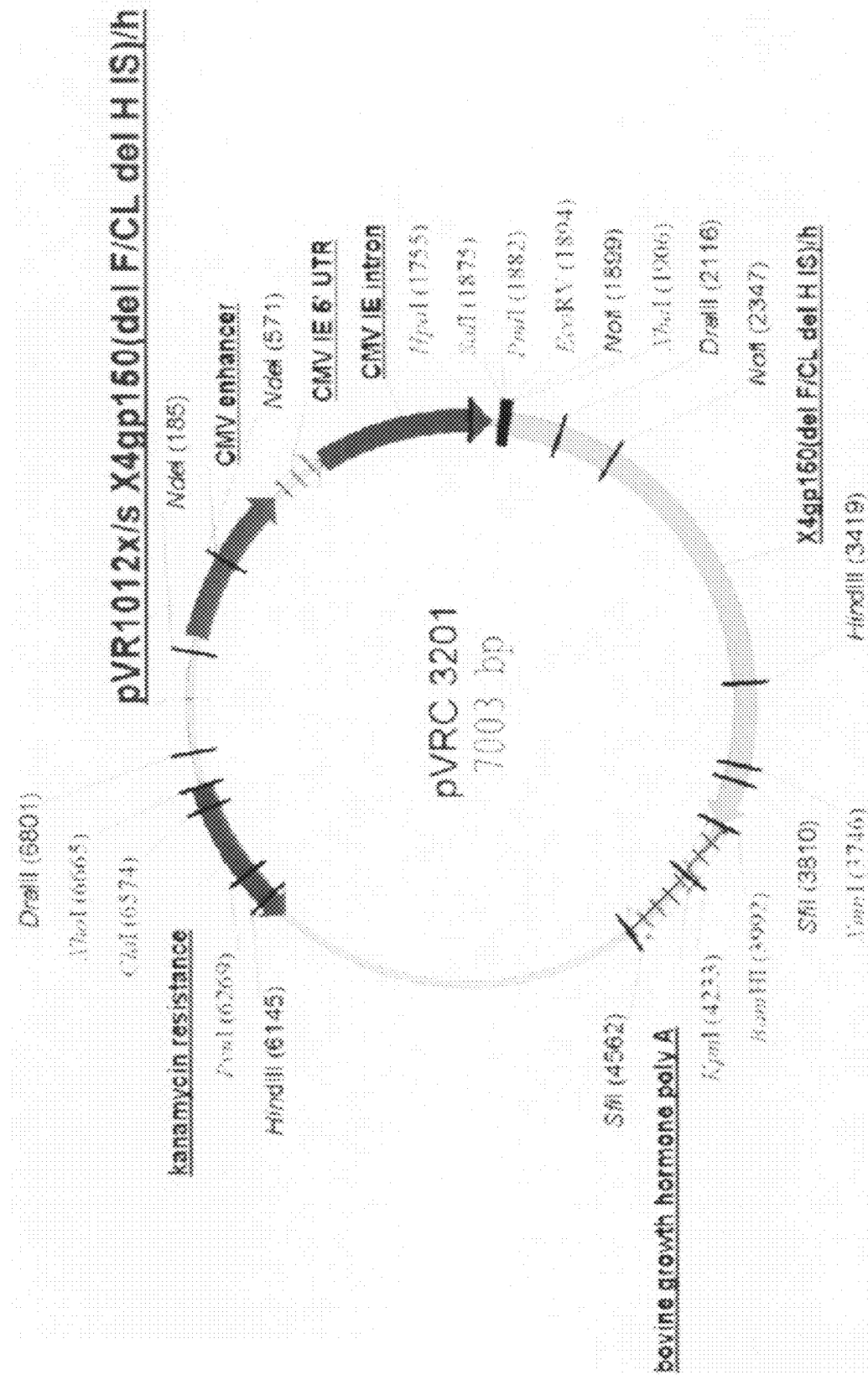
FIG. 73. Plasmid 3201.
Figure 74:
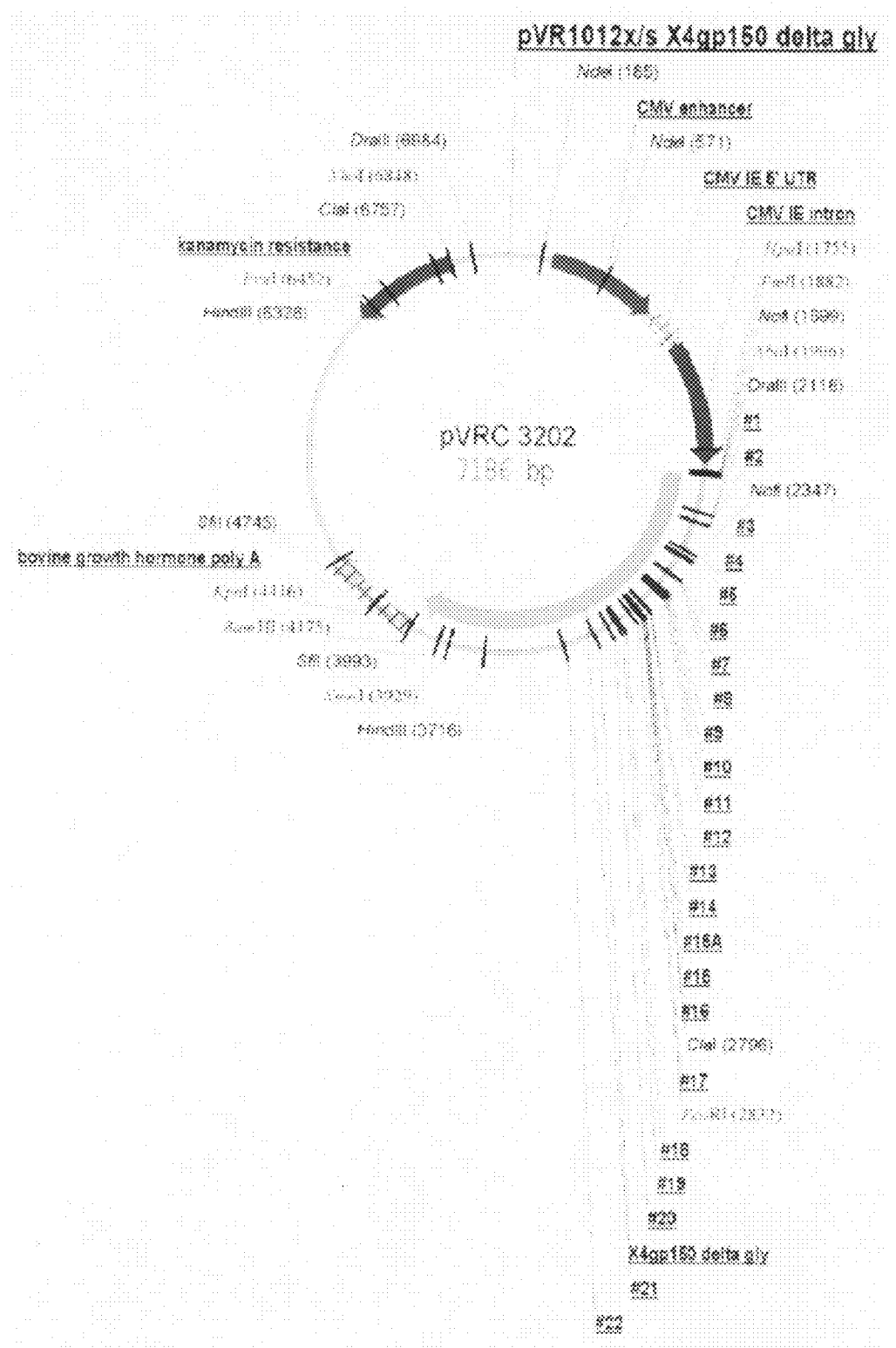
FIG. 74. Plasmid 3202.
Figure 75:
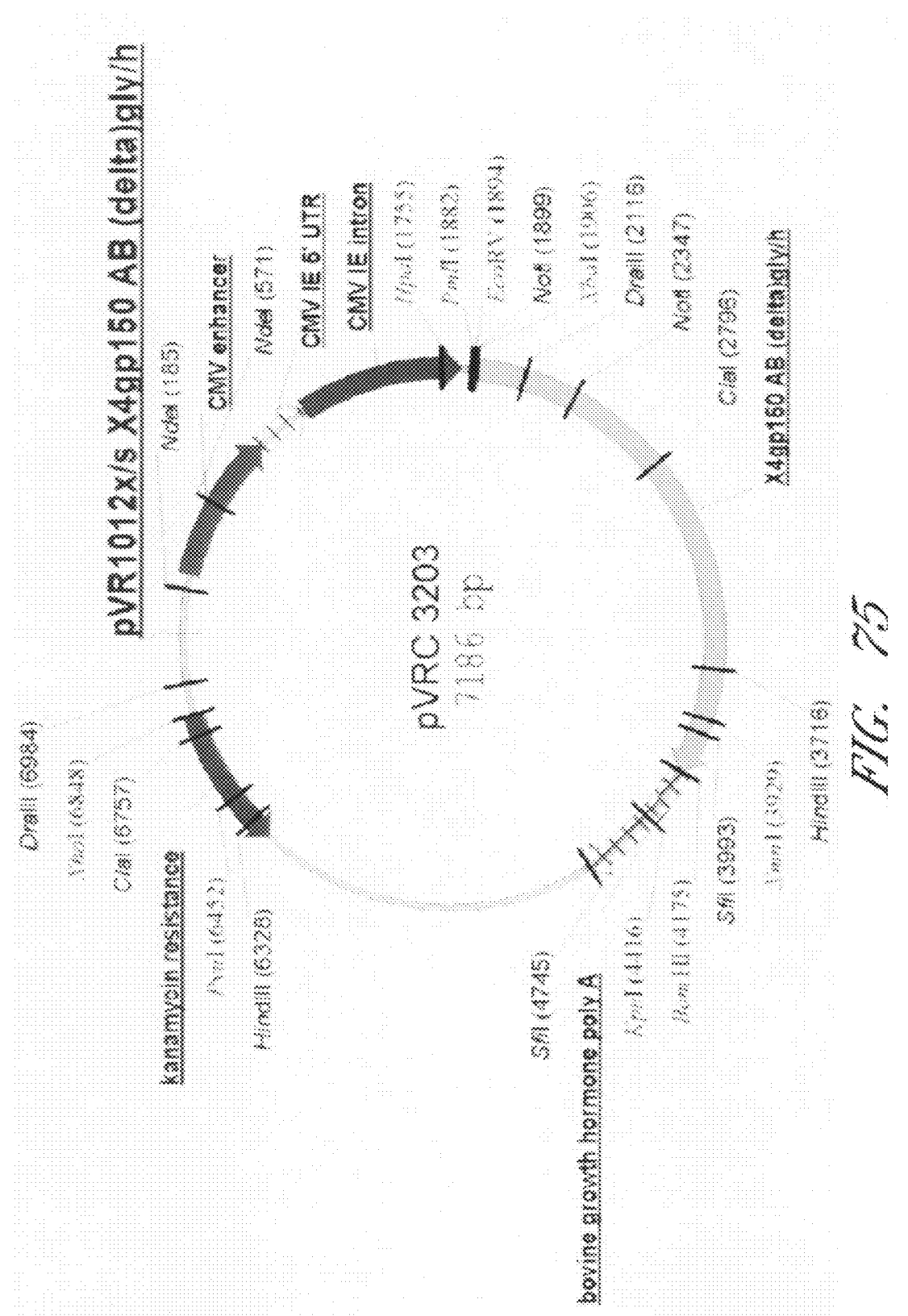
FIG. 75. Plasmid 3203.
Figure 76:
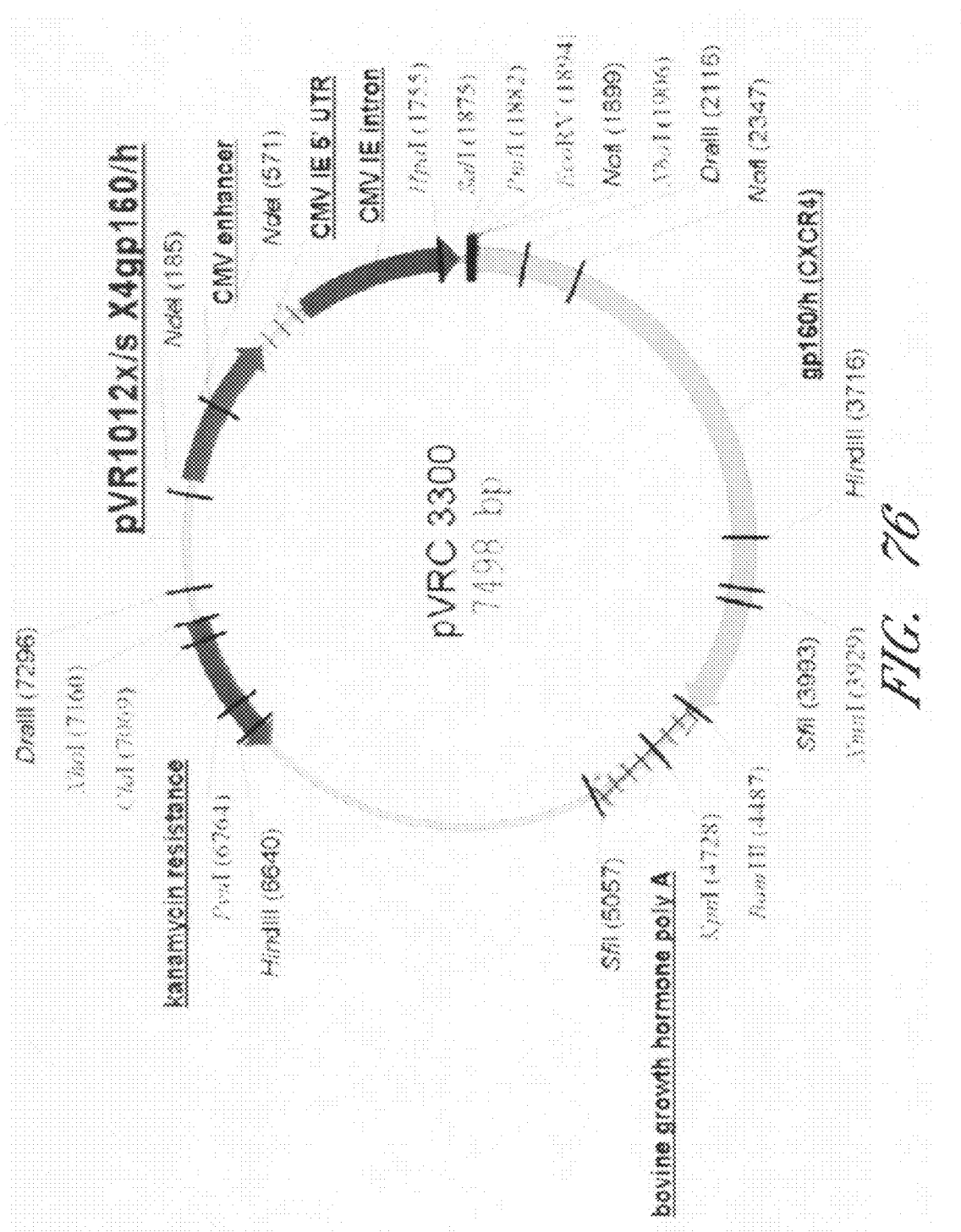
FIG. 76. Plasmid 3300.
Figure 77:
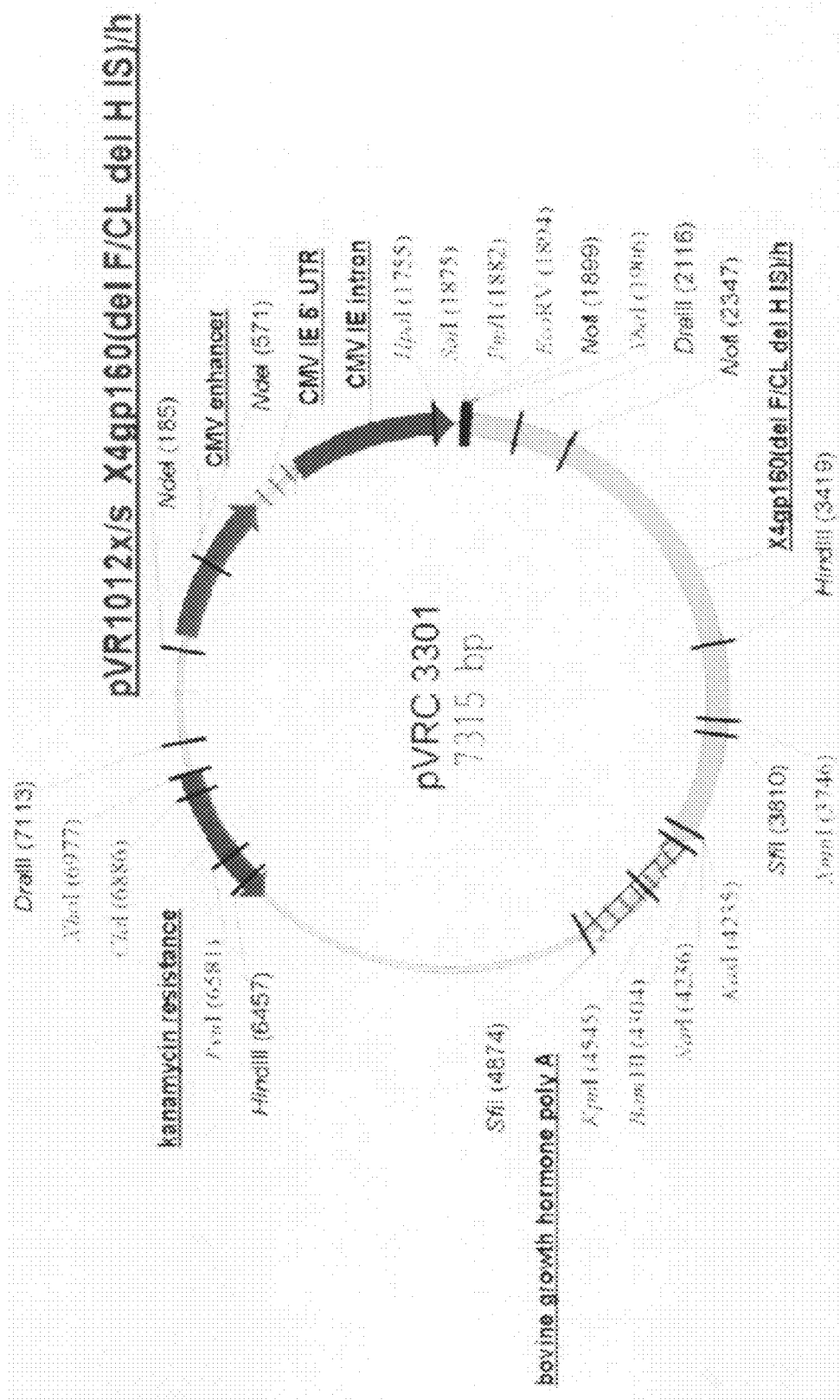
FIG. 77. Plasmid 3301.
Figure 78:
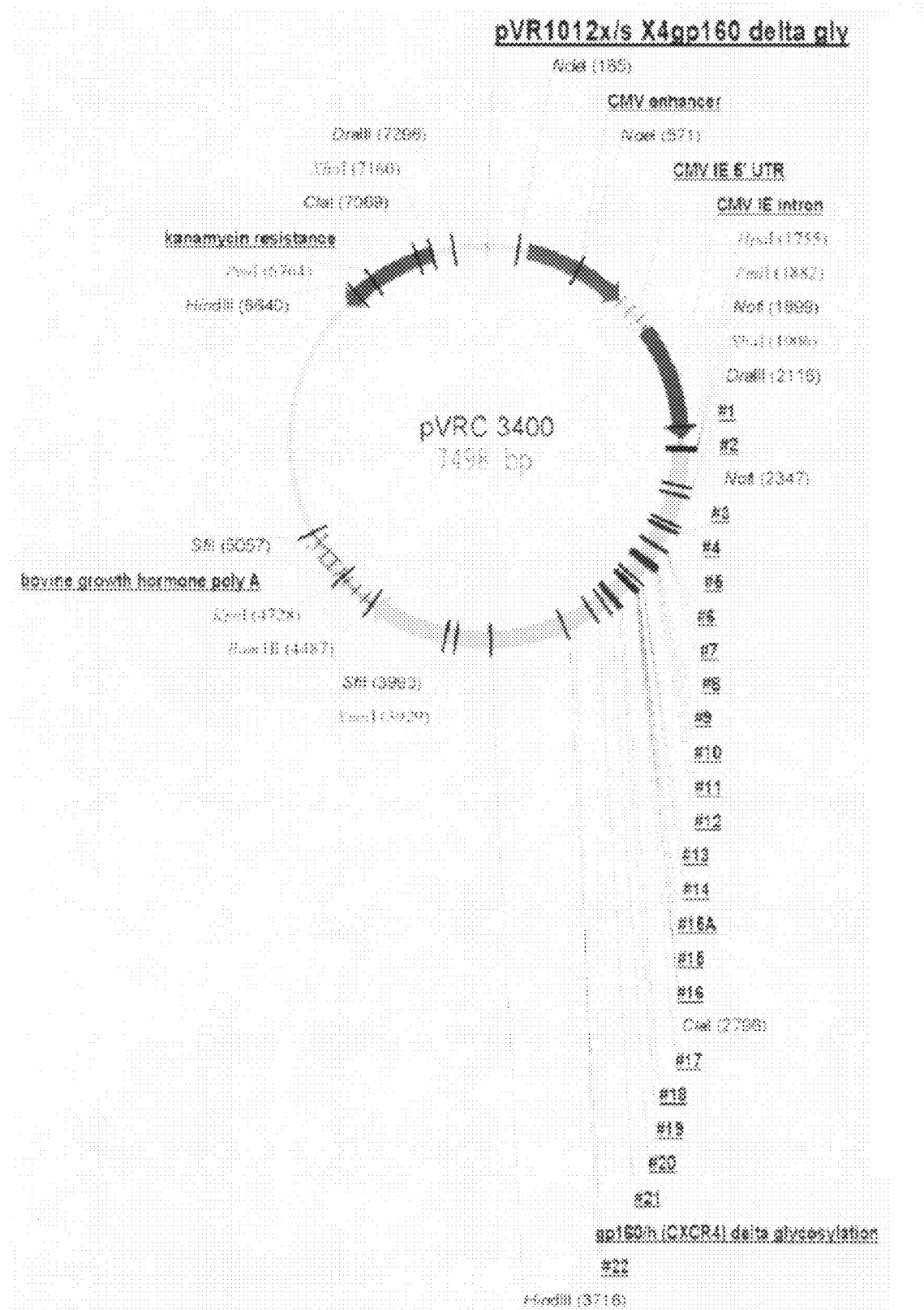
FIG. 78. Plasmid 3400.
Figure 79:
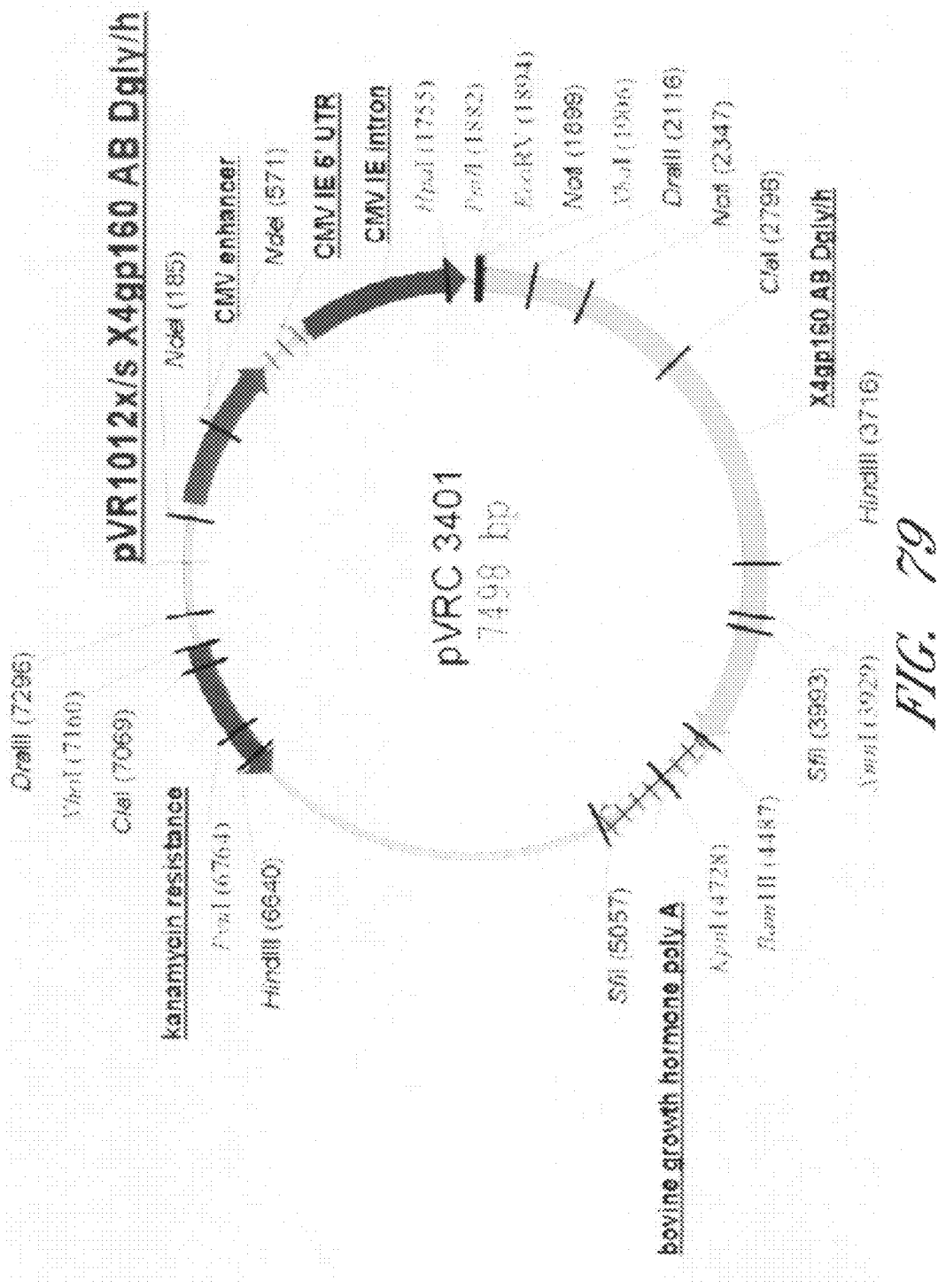
FIG. 79. Plasmid 3401.
Figure 80:
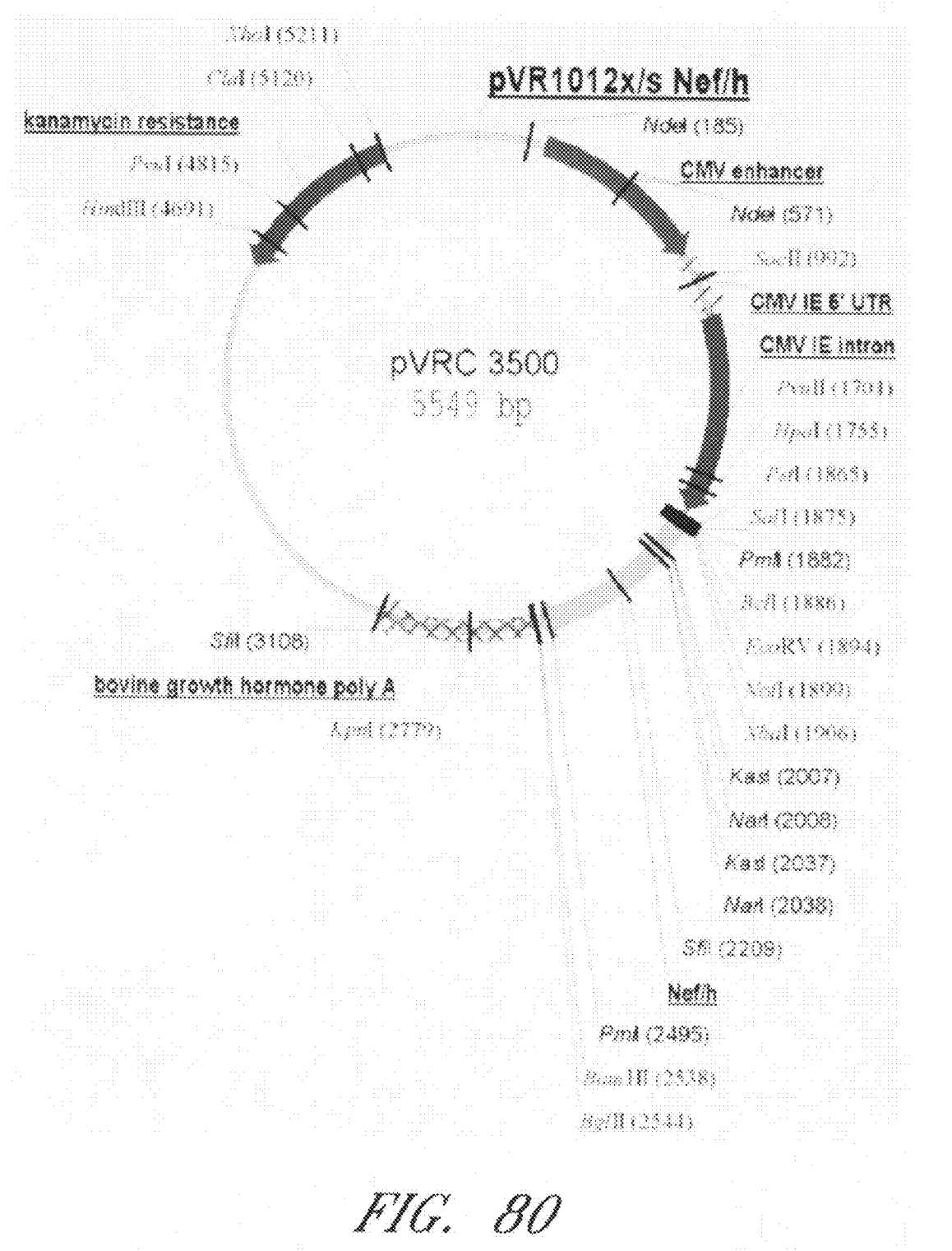
FIG. 80. Plasmid 3500.
Figure 81:
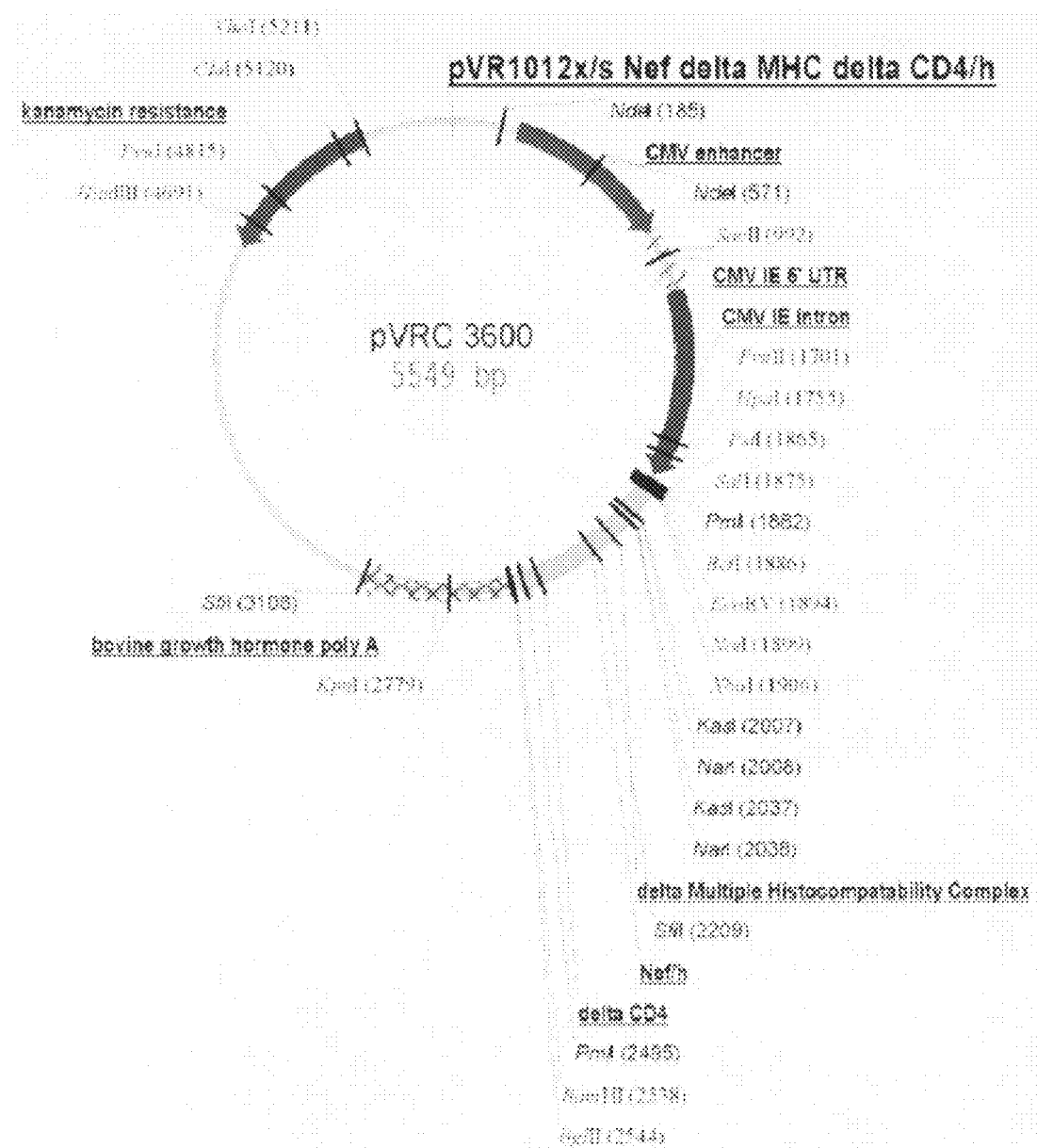
FIG. 81. Plasmid 3600.
Figure 82:
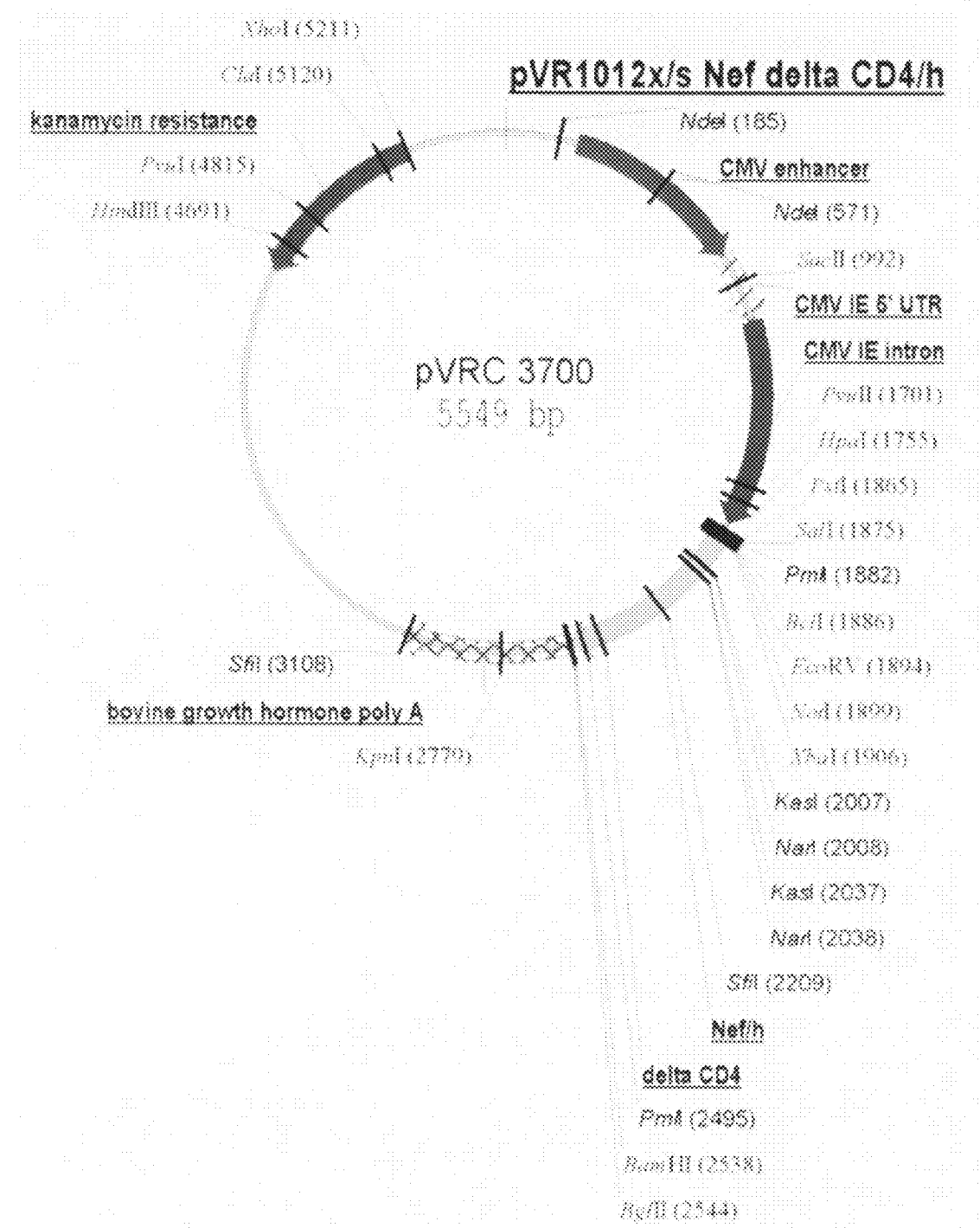
FIG. 82. Plasmid 3700.
Figure 83:
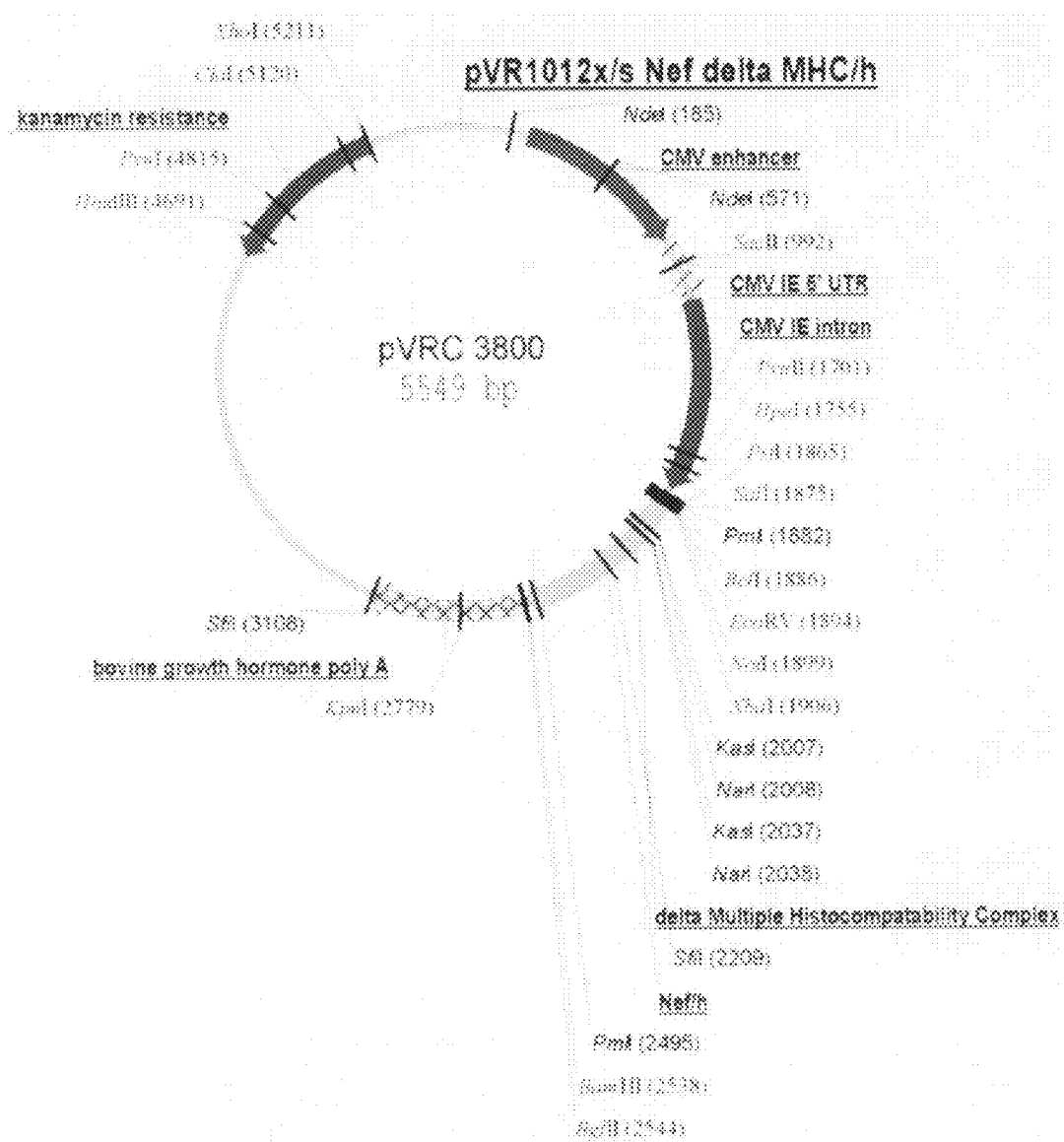
FIG. 83. Plasmid 3800.
Figure 84:
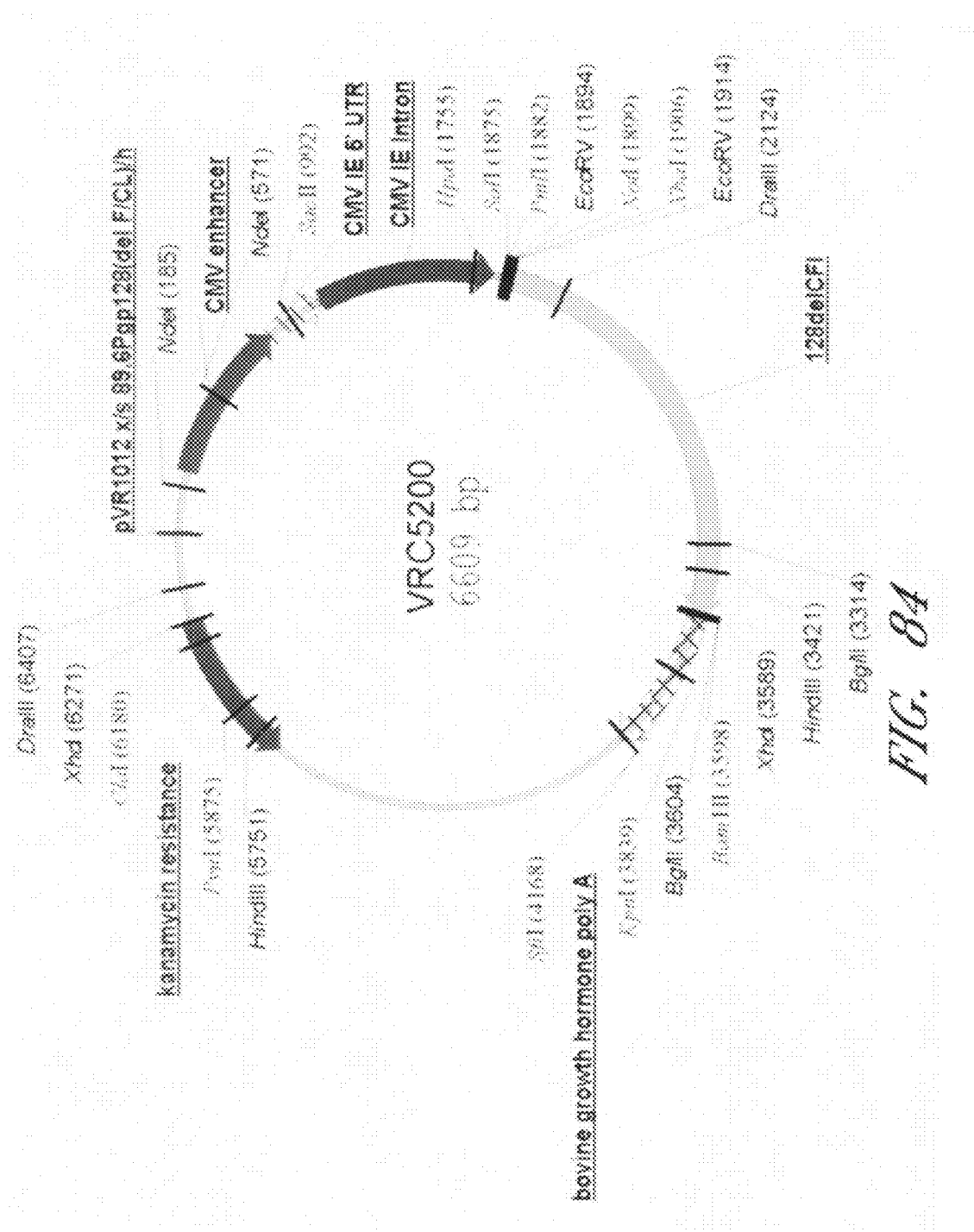
FIG. 84. Plasmid 5200.
Figure 85:
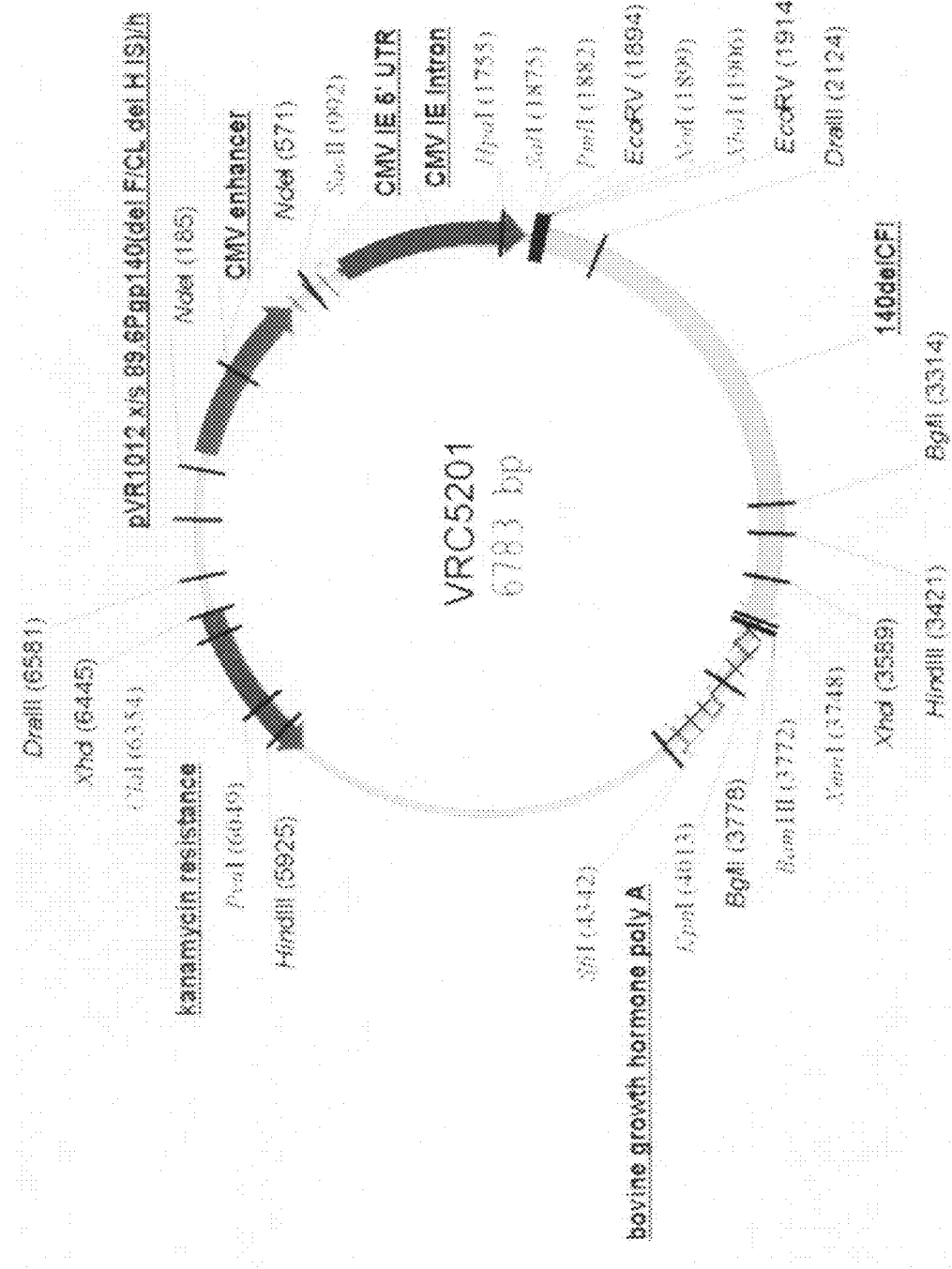
FIG. 85. Plasmid 5201.
Figure 86:
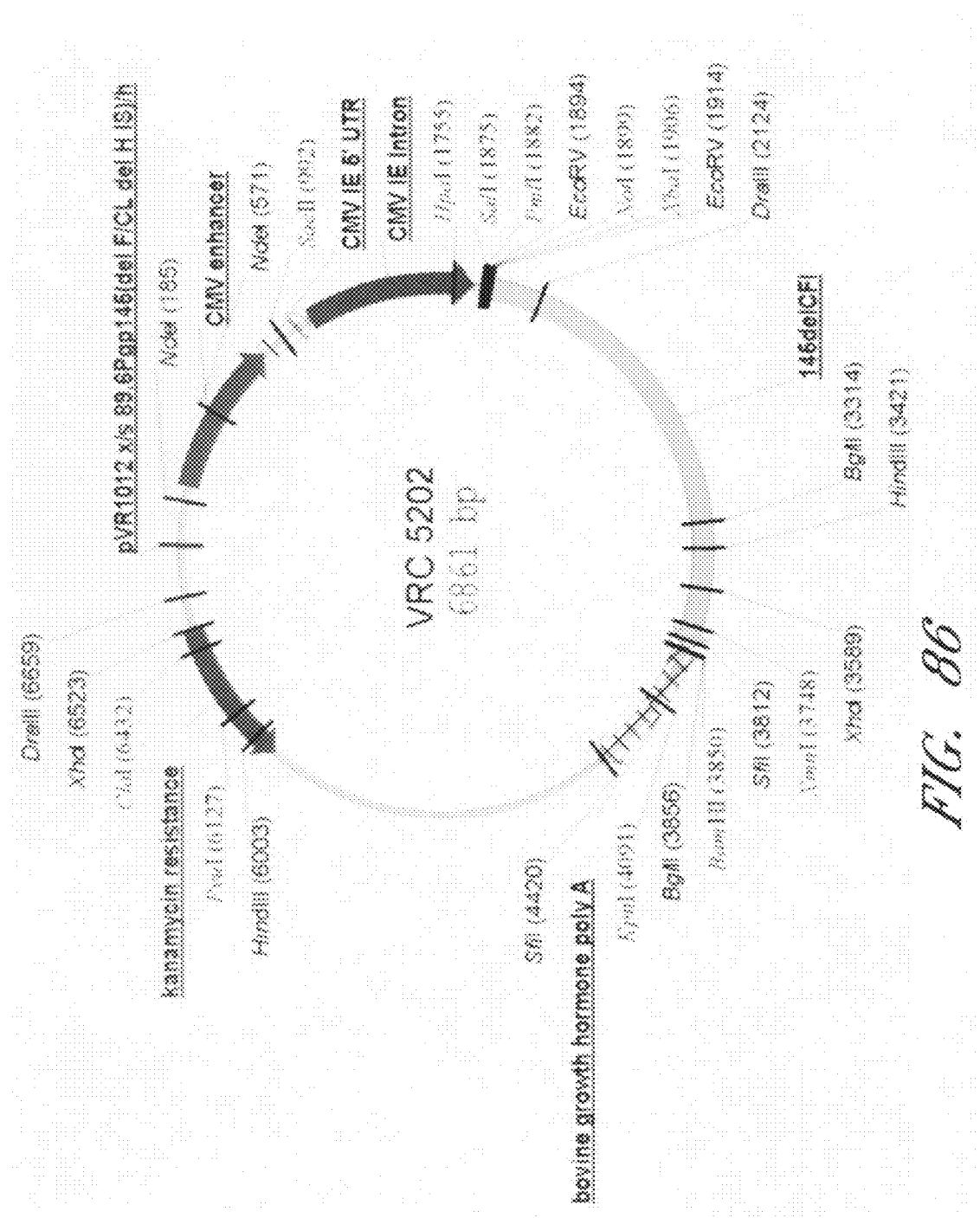
FIG. 86. Plasmid 5202.
Figure 87:
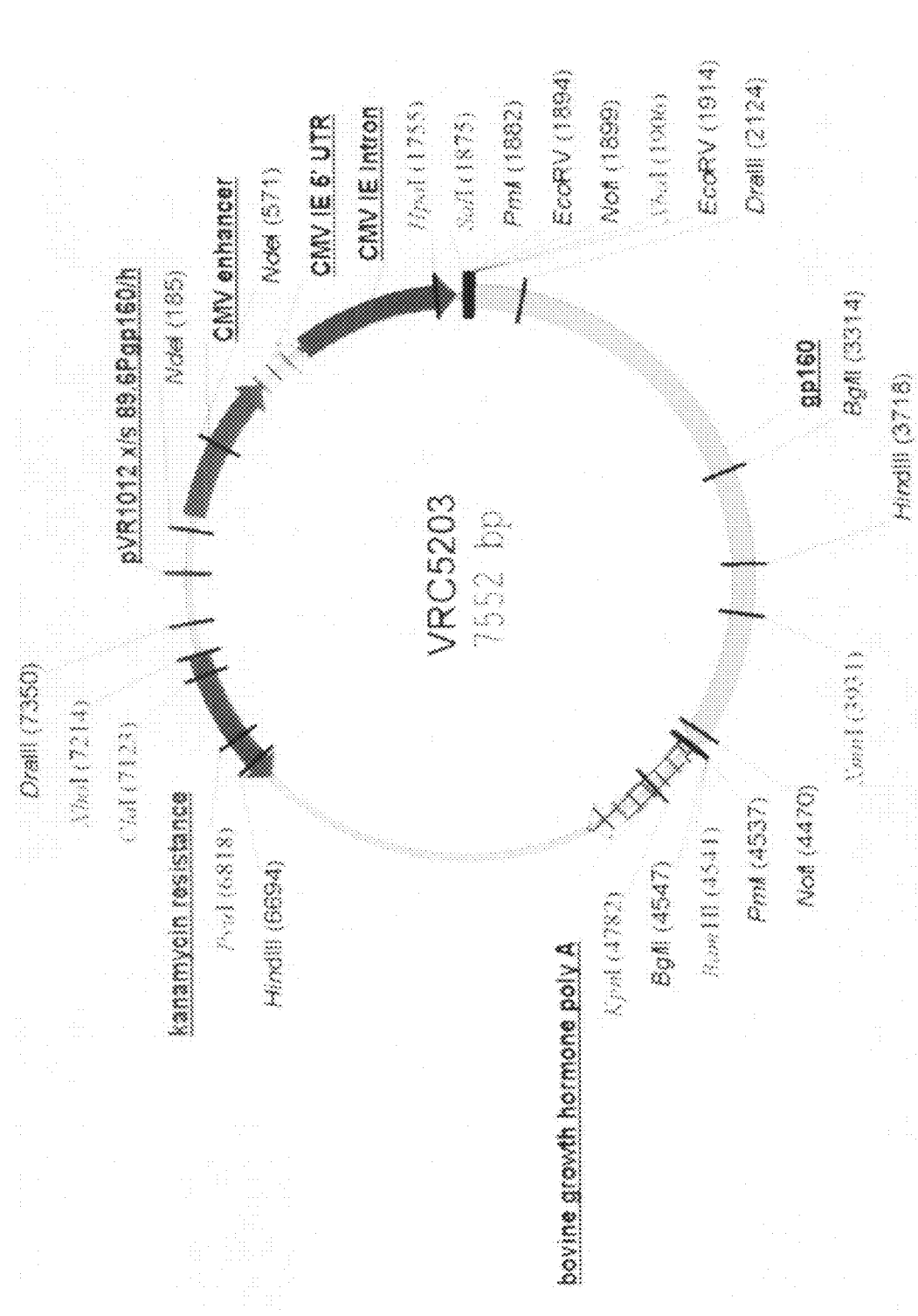
FIG. 87. Plasmid 5203.
Figure 88:
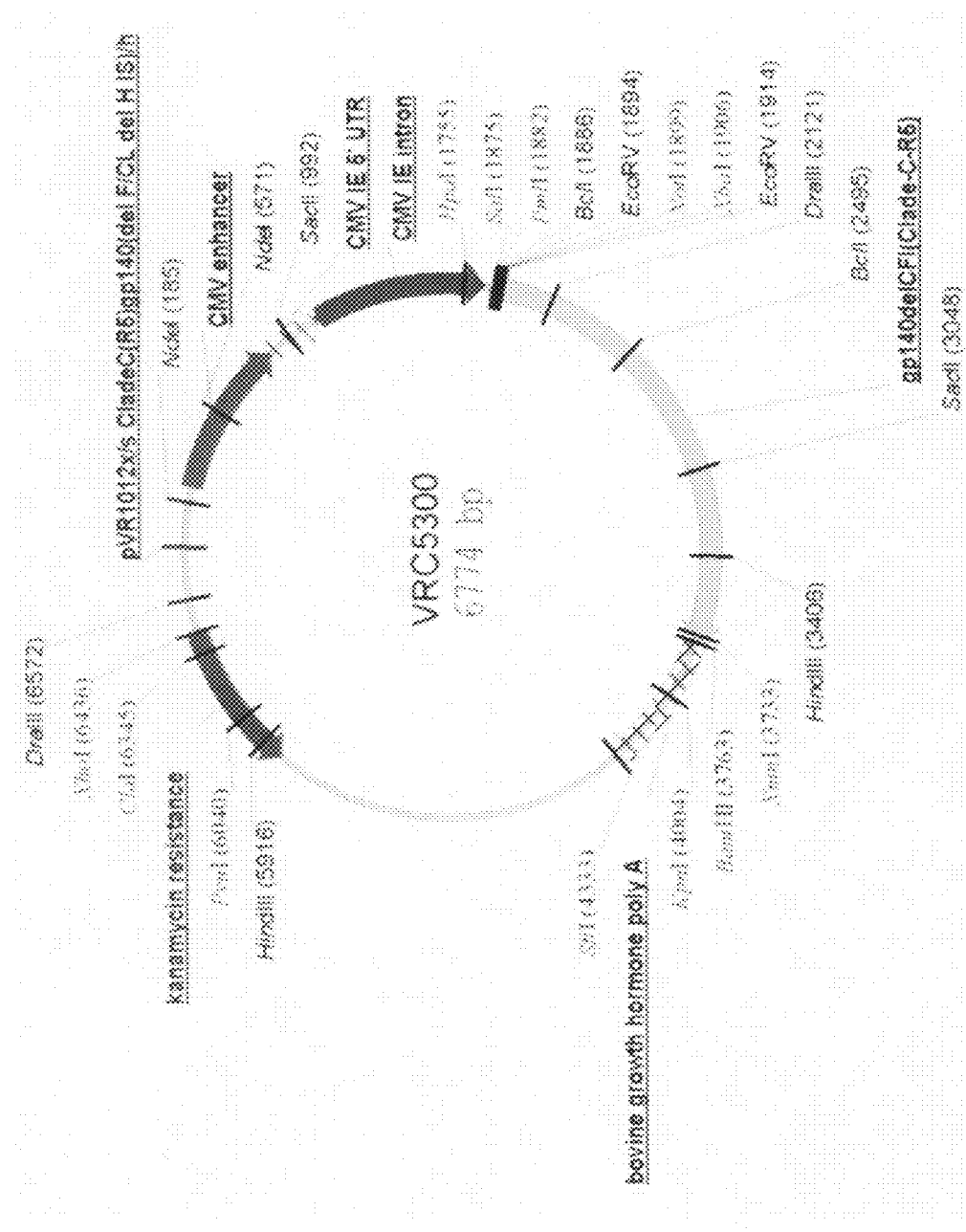
FIG. 88. Plasmid 5300.
Figure 89:
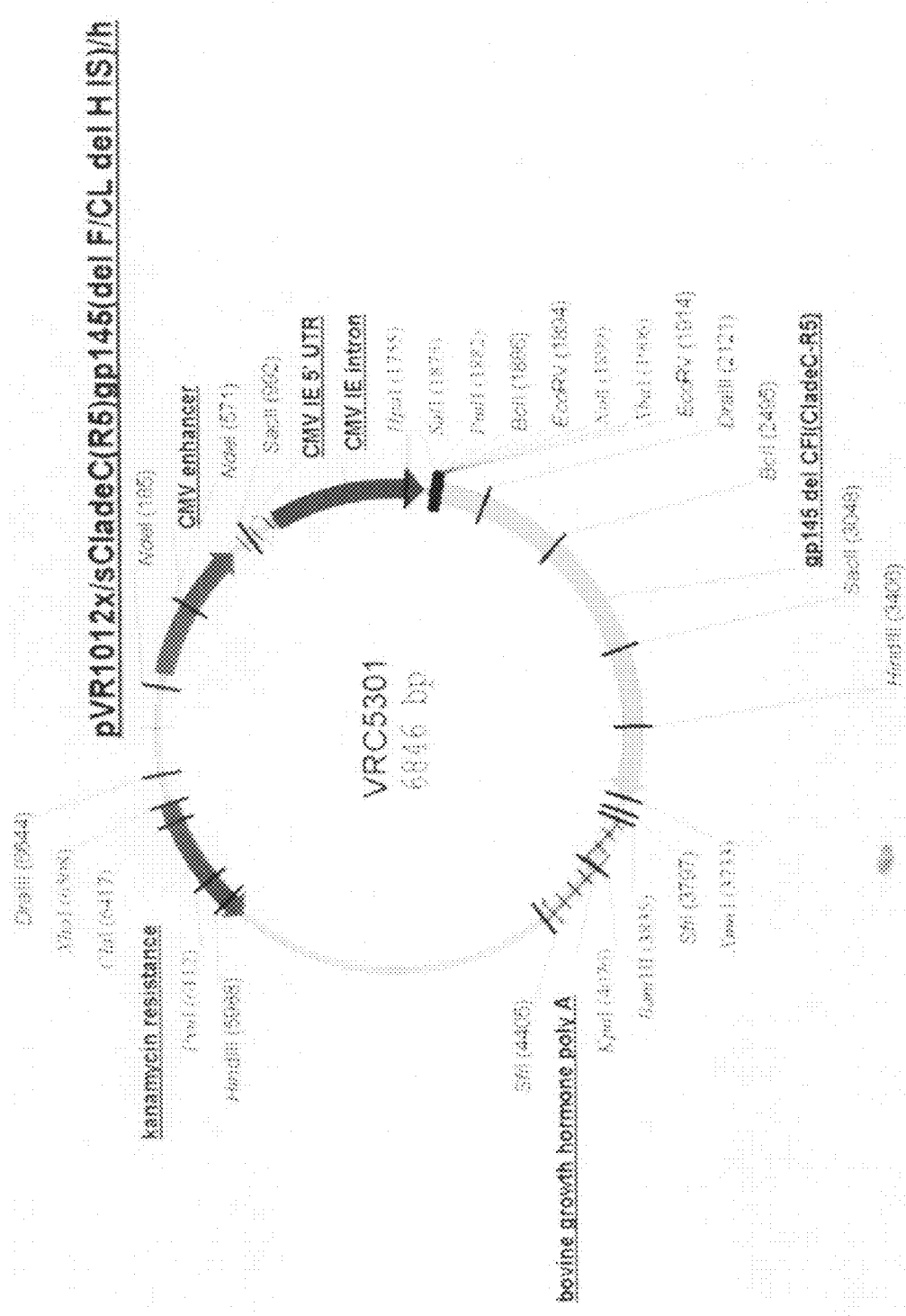
FIG. 89. Plasmid 5301.
Figure 90:
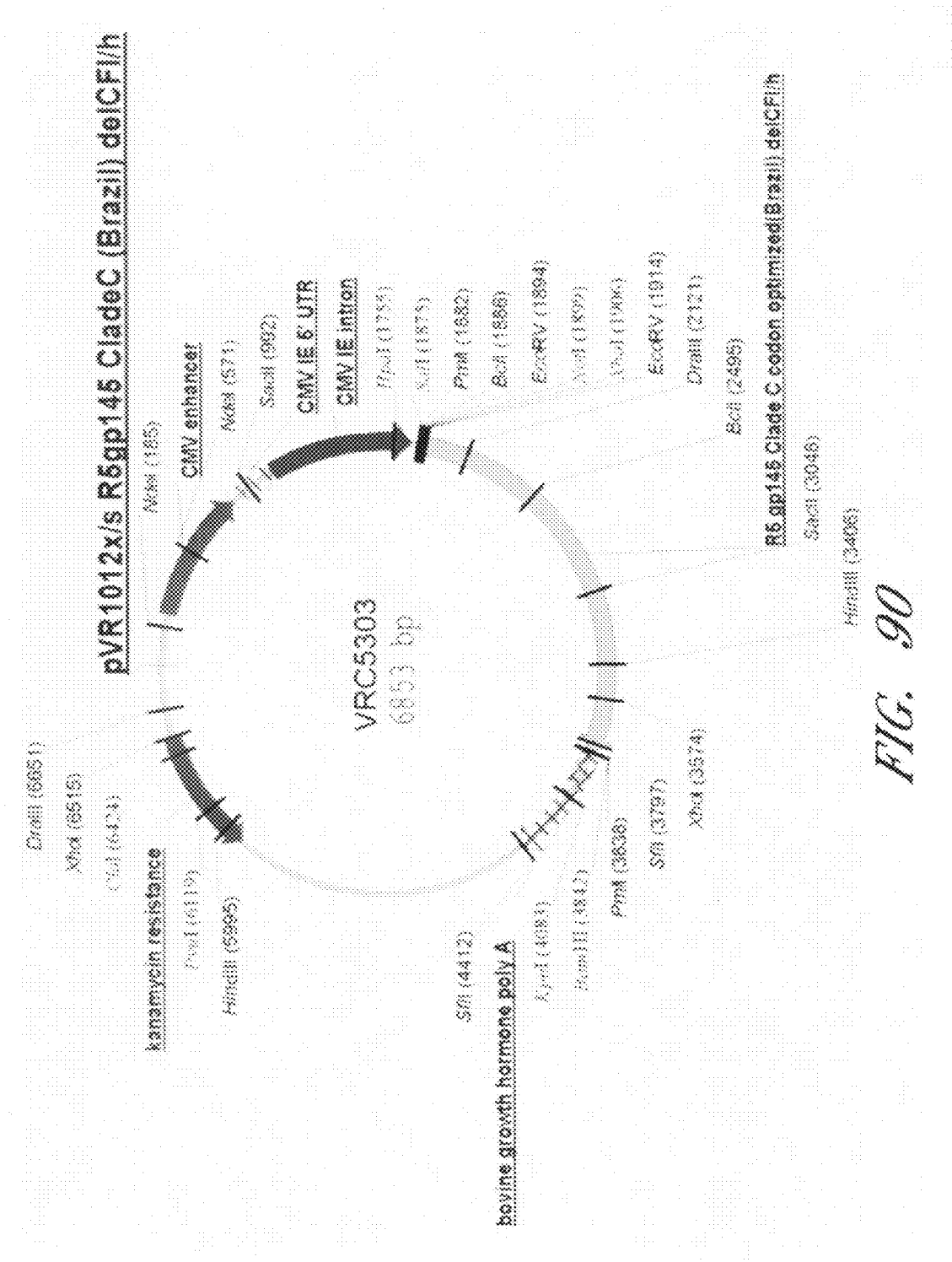
FIG. 90. Plasmid 5303.
Figure 91:
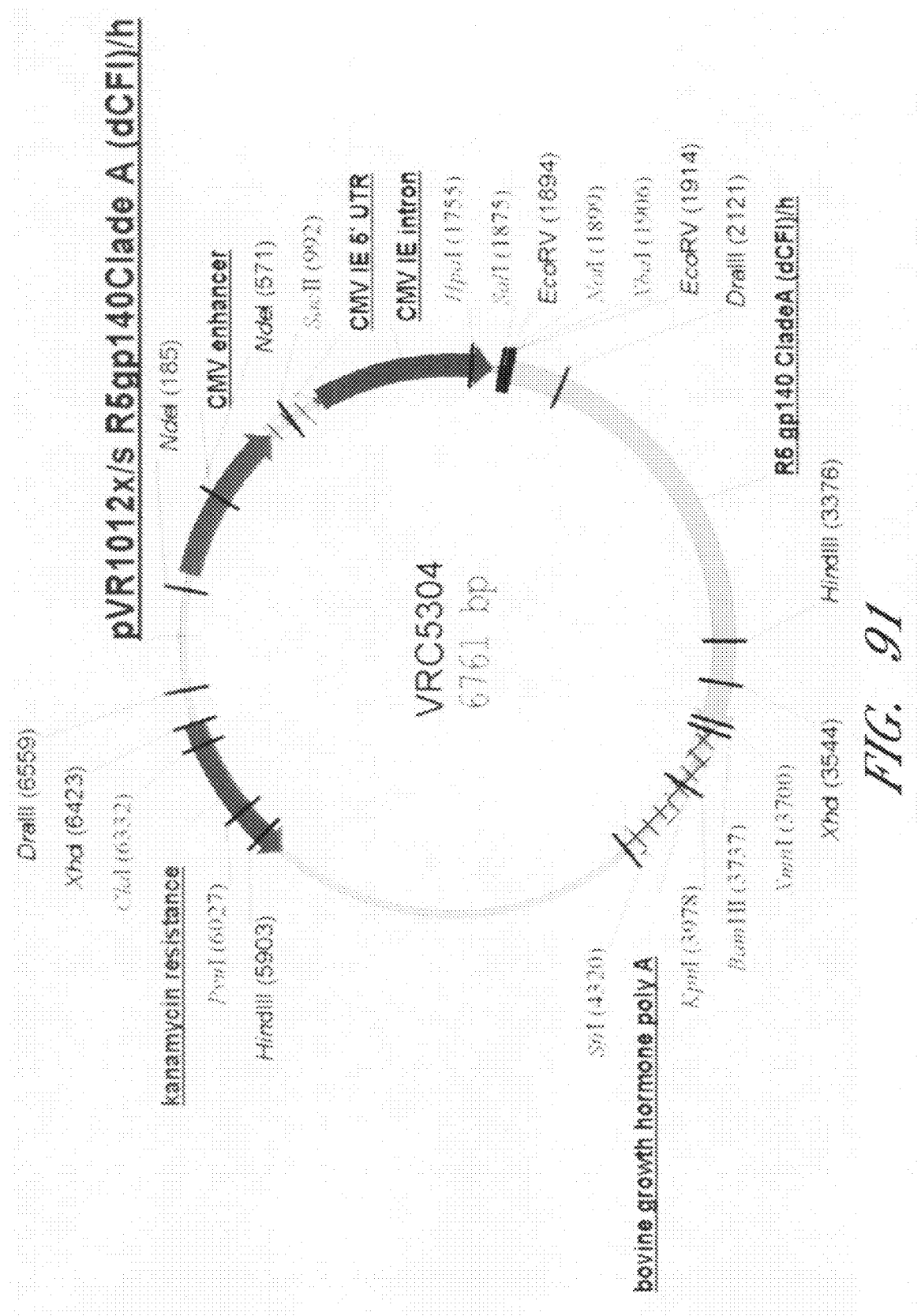
FIG. 91. Plasmid 5304.
Figure 92:
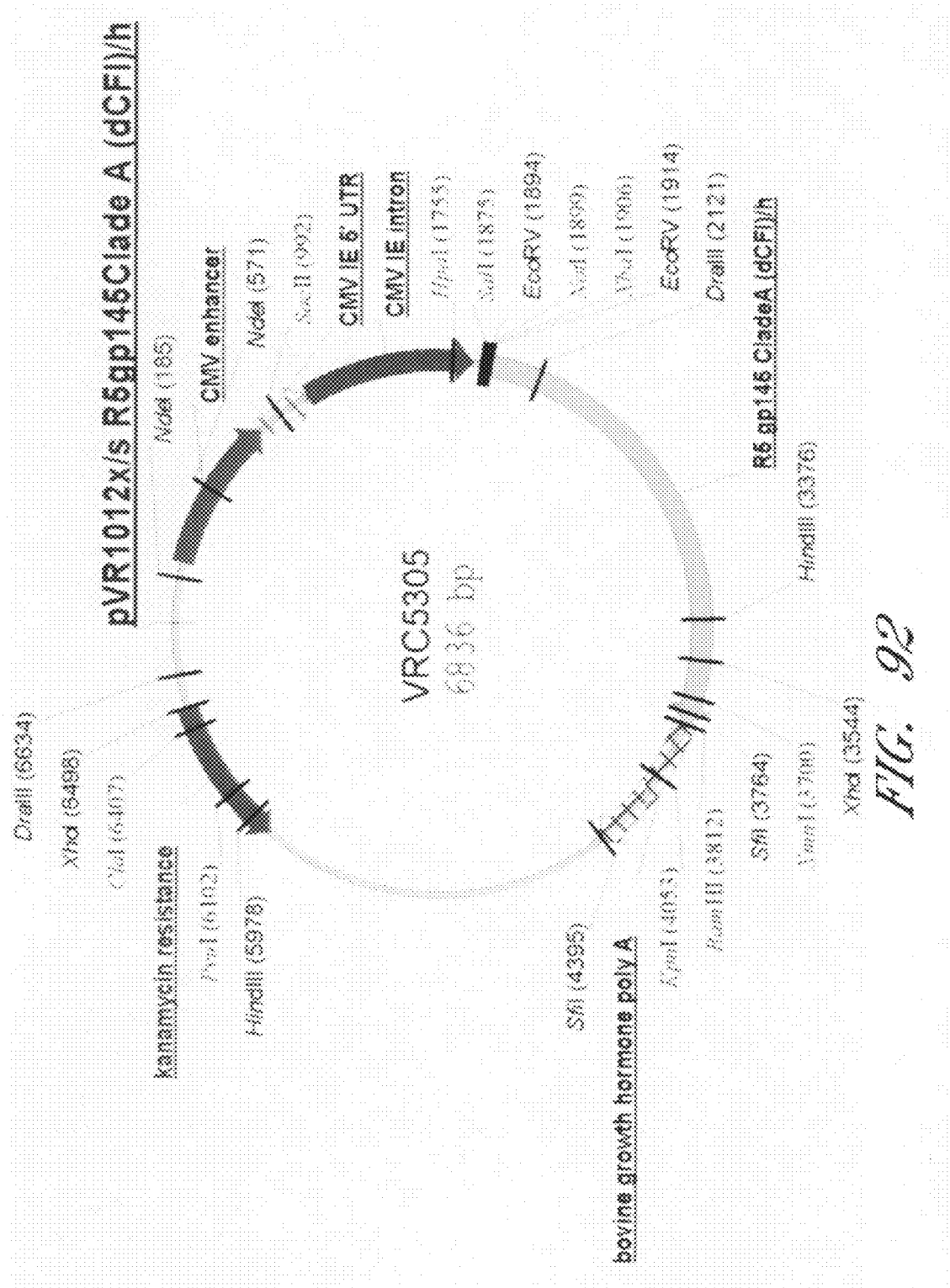
FIG. 92. Plasmid 5305.
Figure 93:
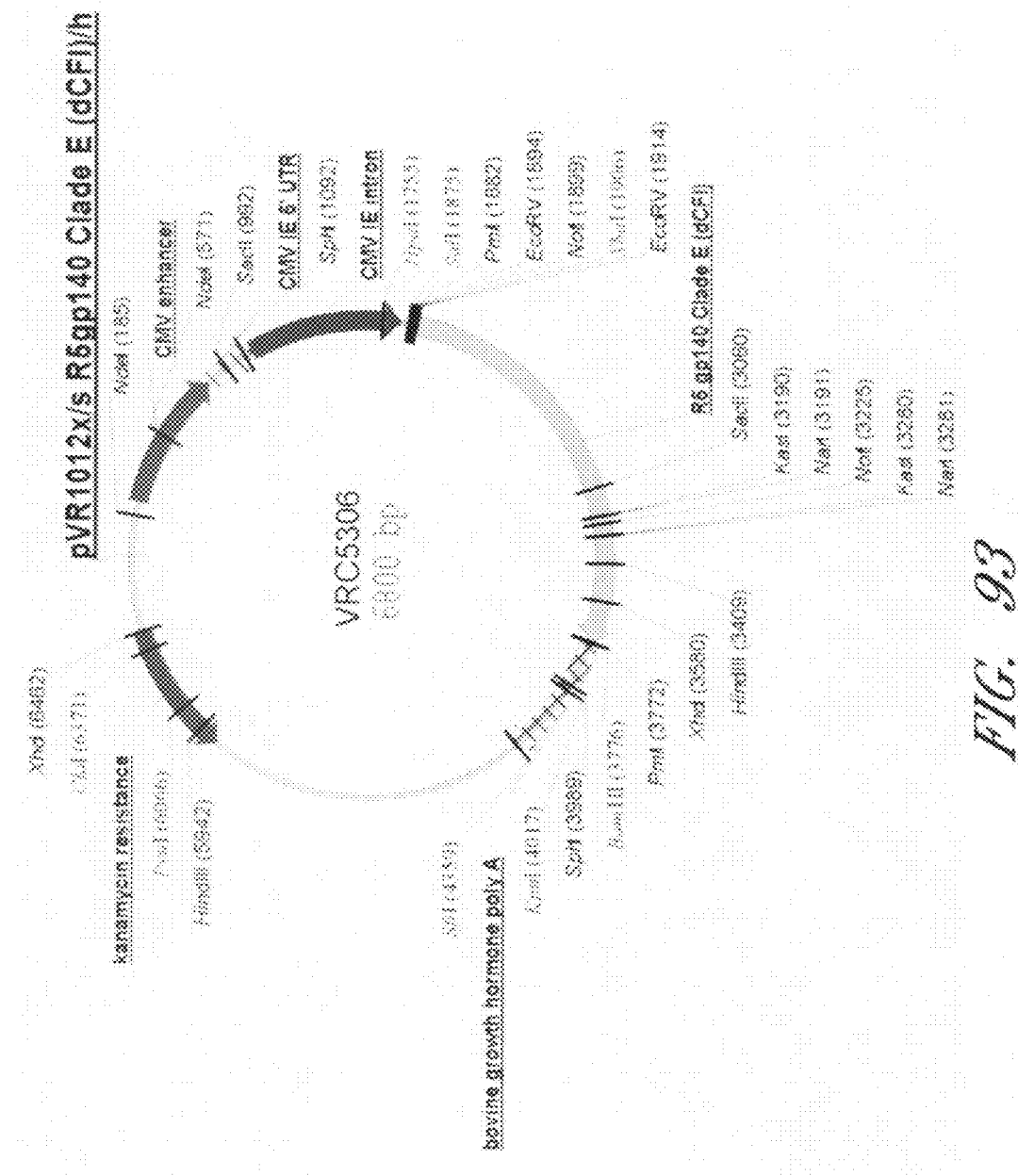
FIG. 93. Plasmid 5306.
Figure 94:
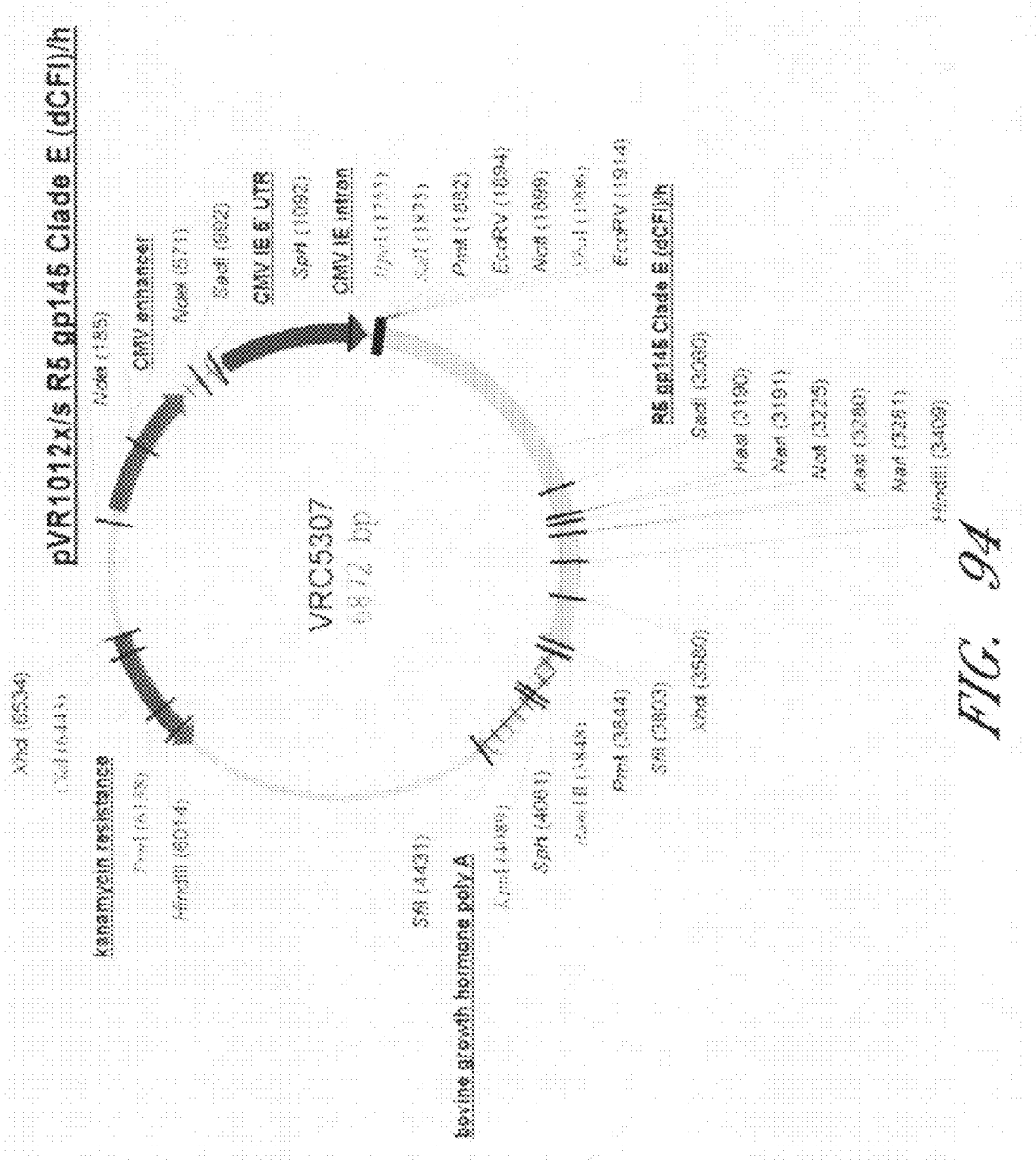
FIG. 94. Plasmid 5307.
Figure 95:
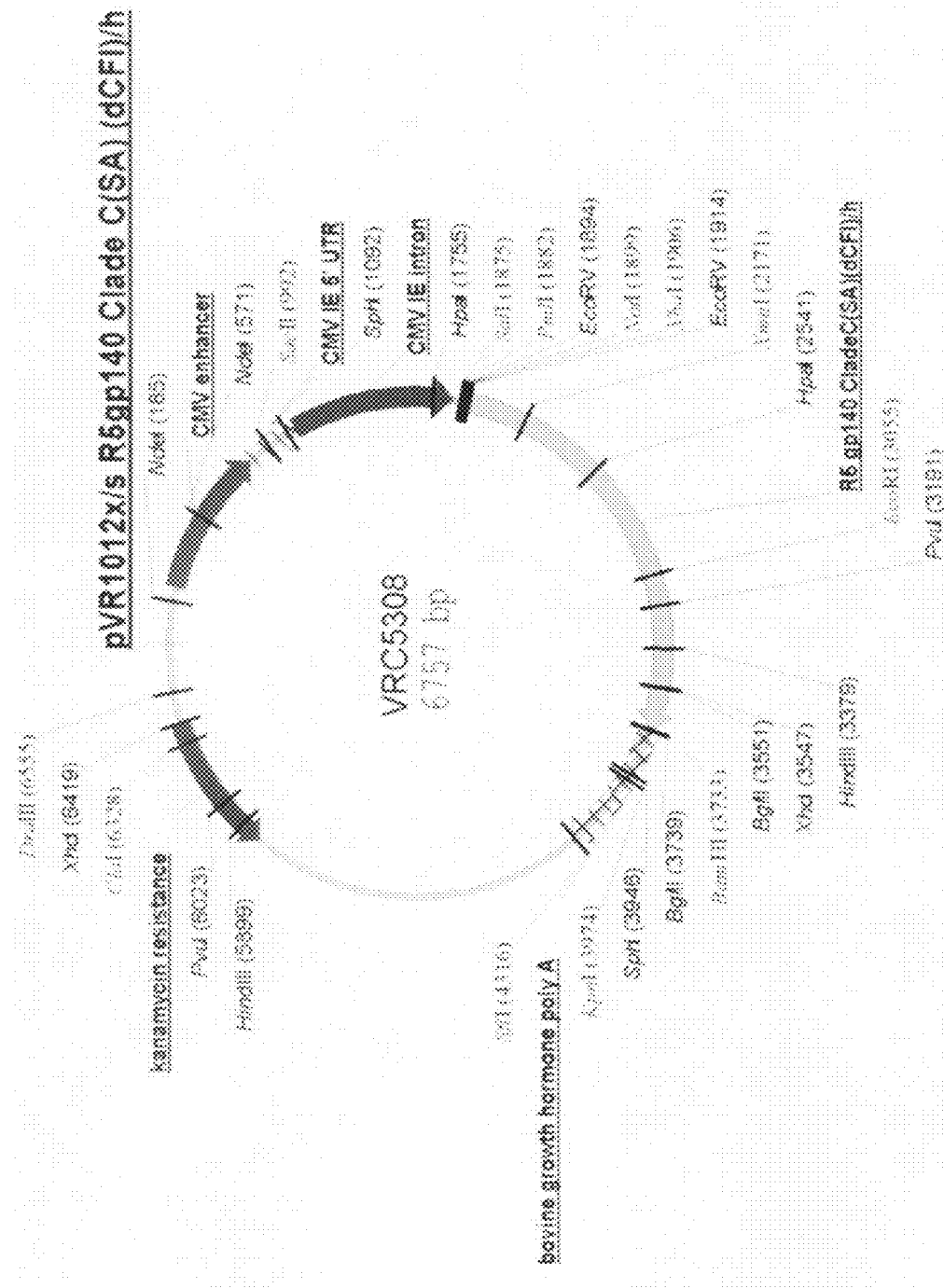
FIG. 95. Plasmid 5308.
Figure 96:
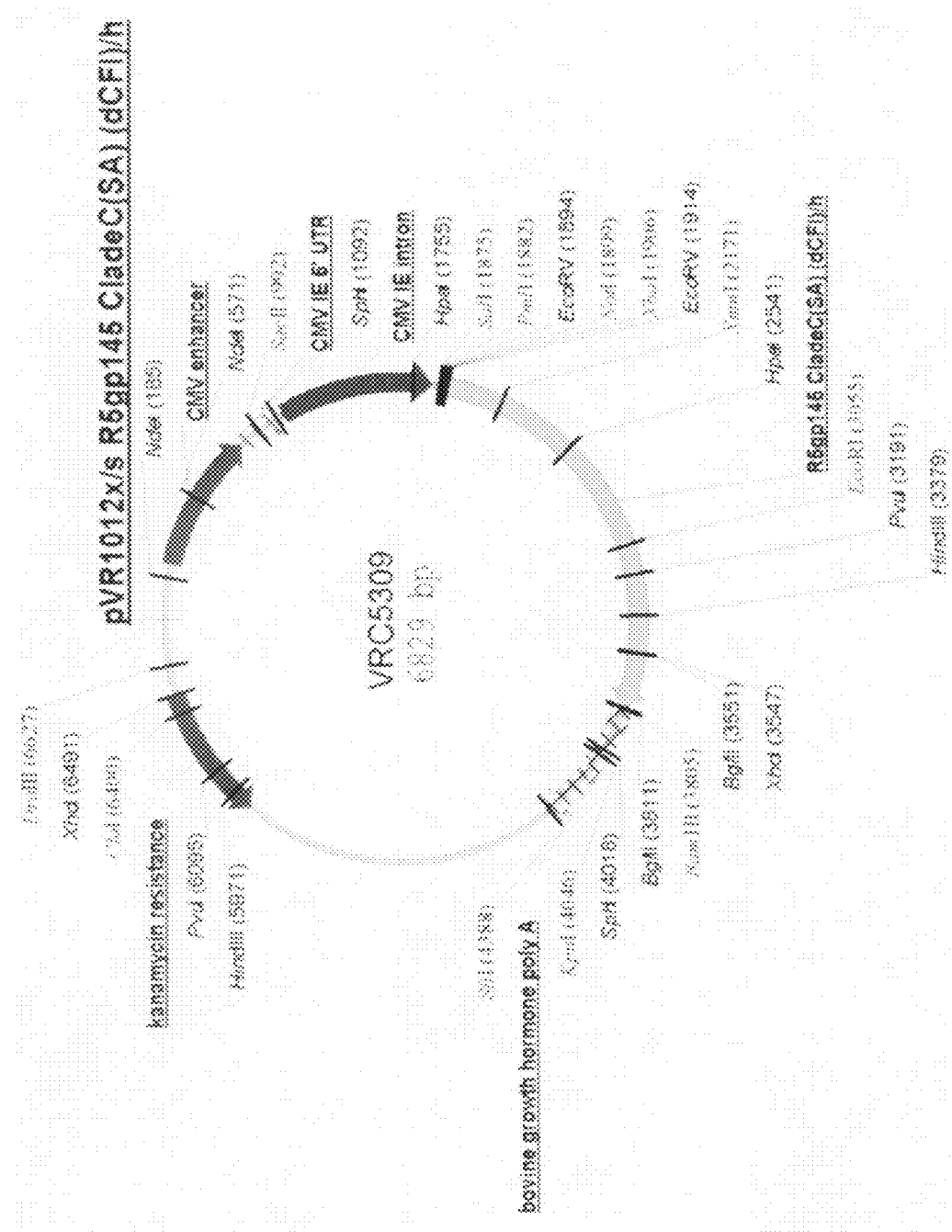
FIG. 96. Plasmid 5309.
Figure 97:
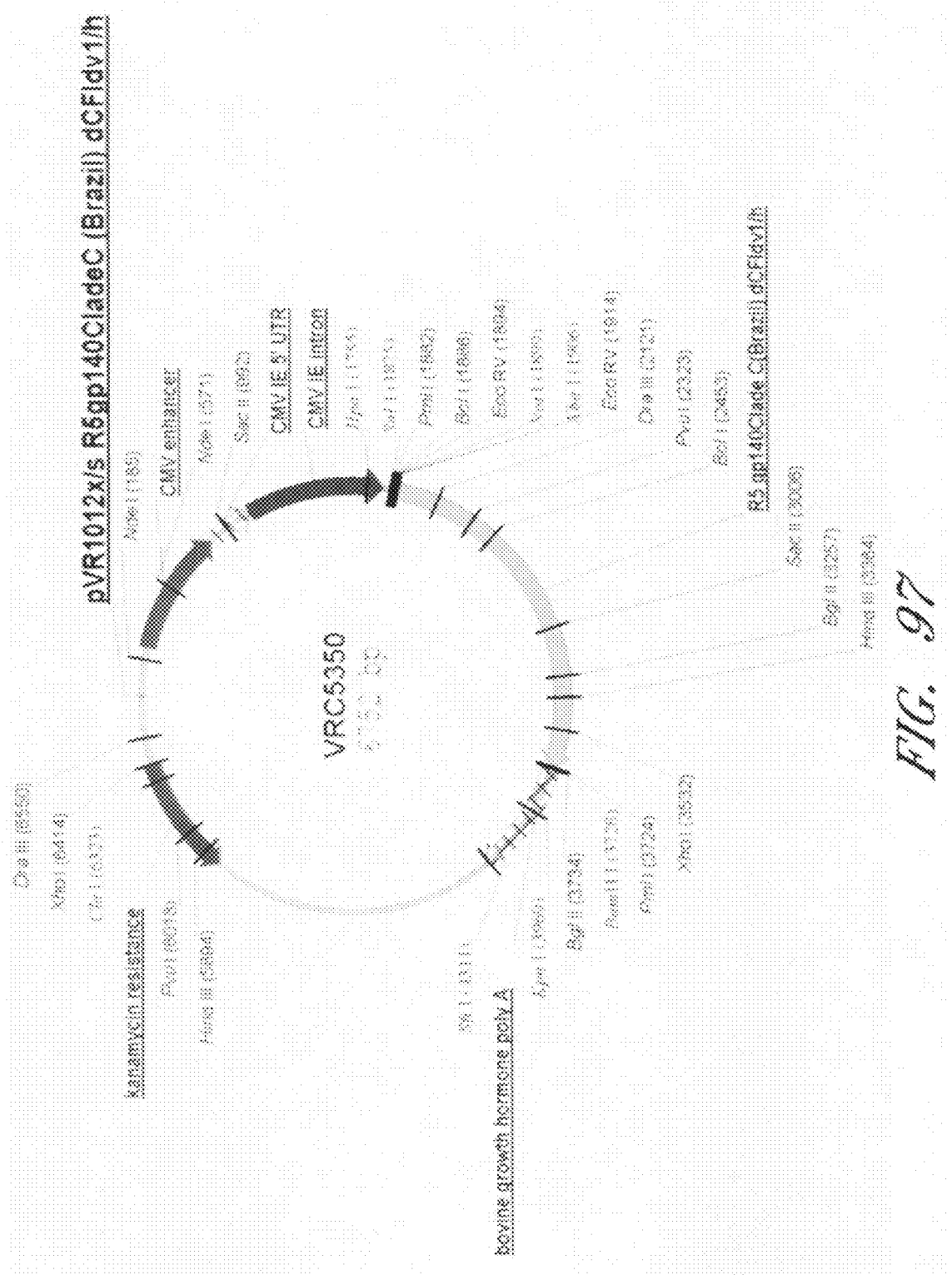
FIG. 97. Plasmid 5350.
Figure 98:
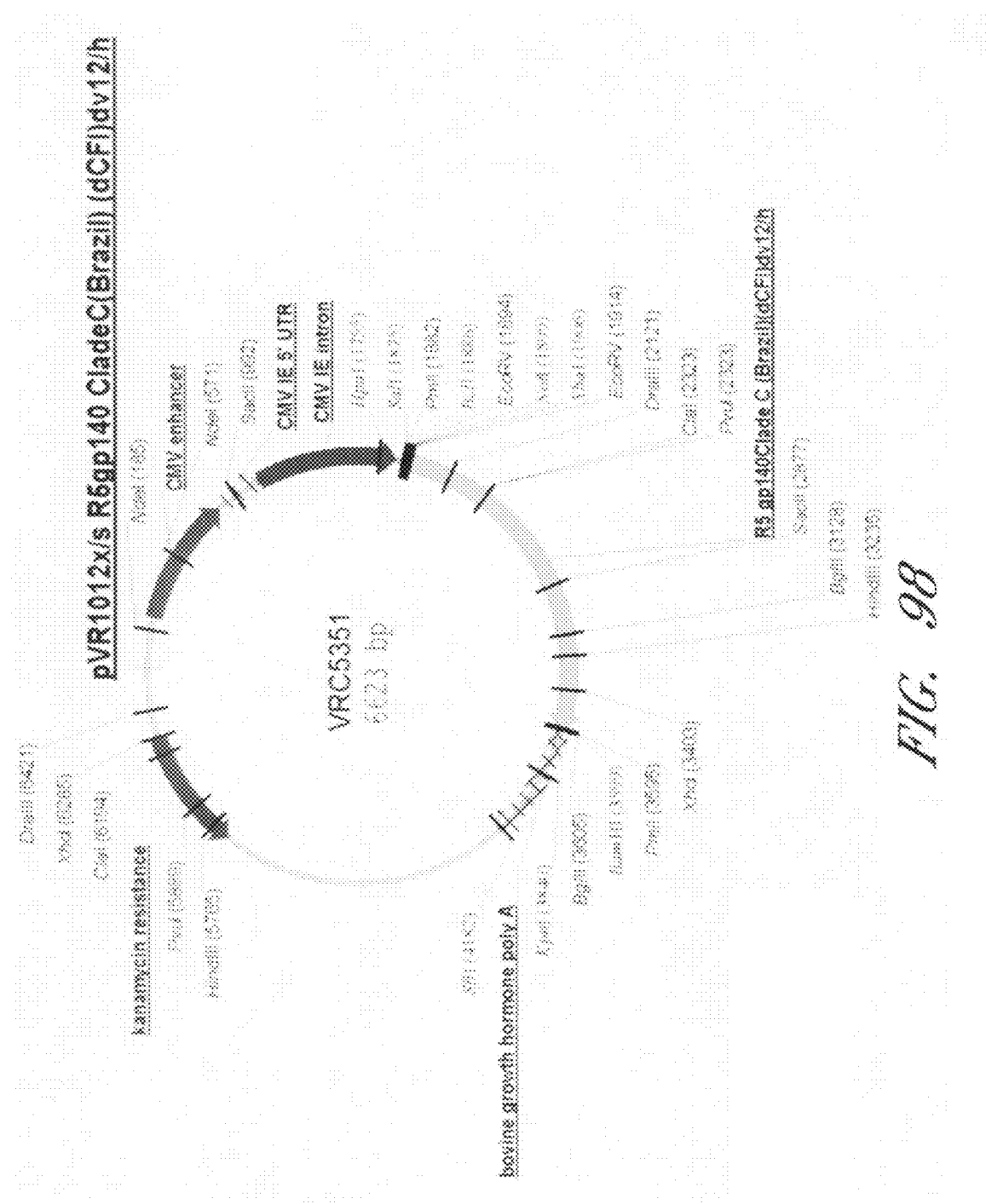
FIG. 98. Plasmid 5351.
Figure 99:
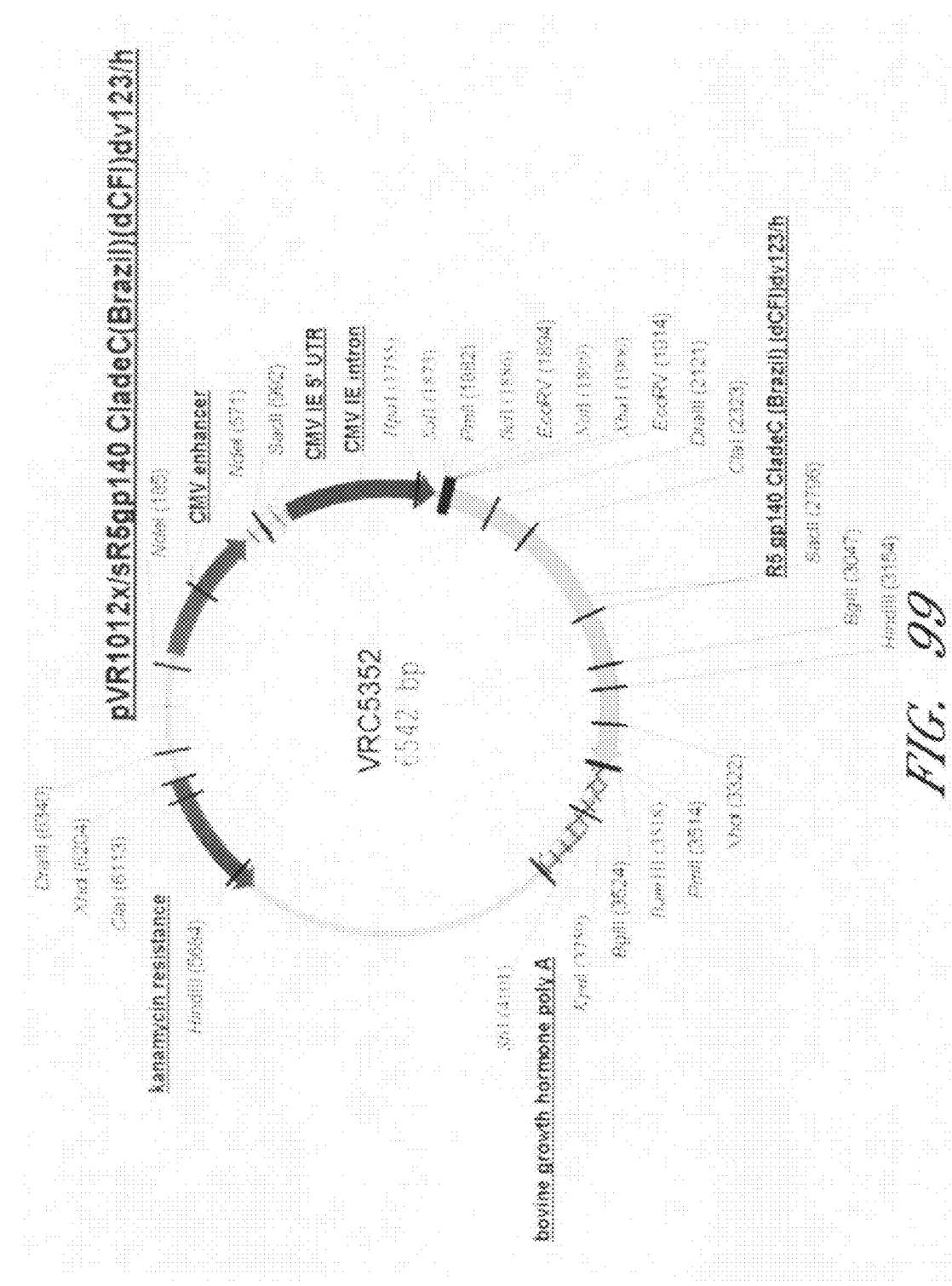
FIG. 99. Plasmid 5352.
Figure 100:
FIG. 100. Plasmid 5353.
Figure 101:
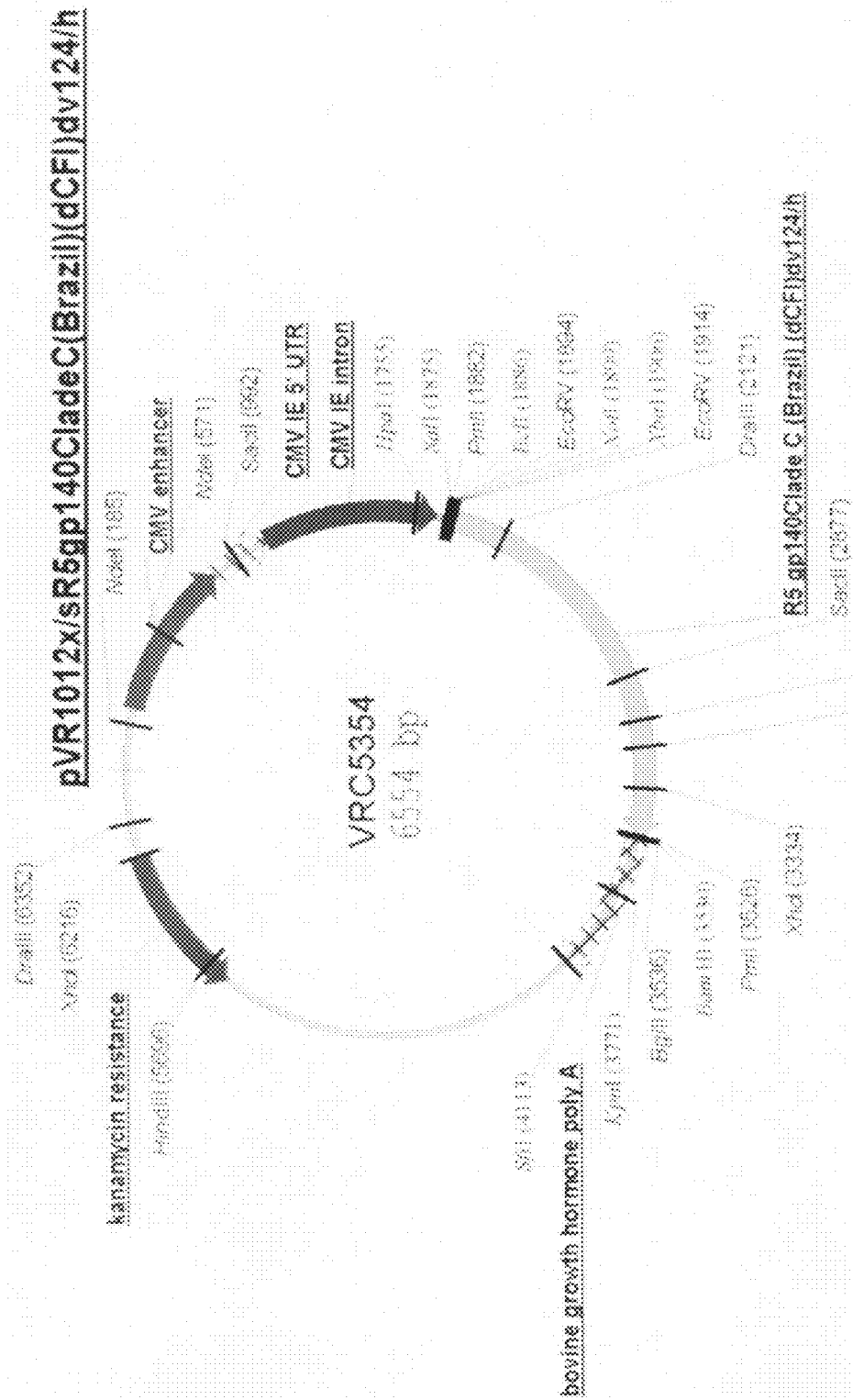
FIG. 101. Plasmid 5354.
Figure 102:
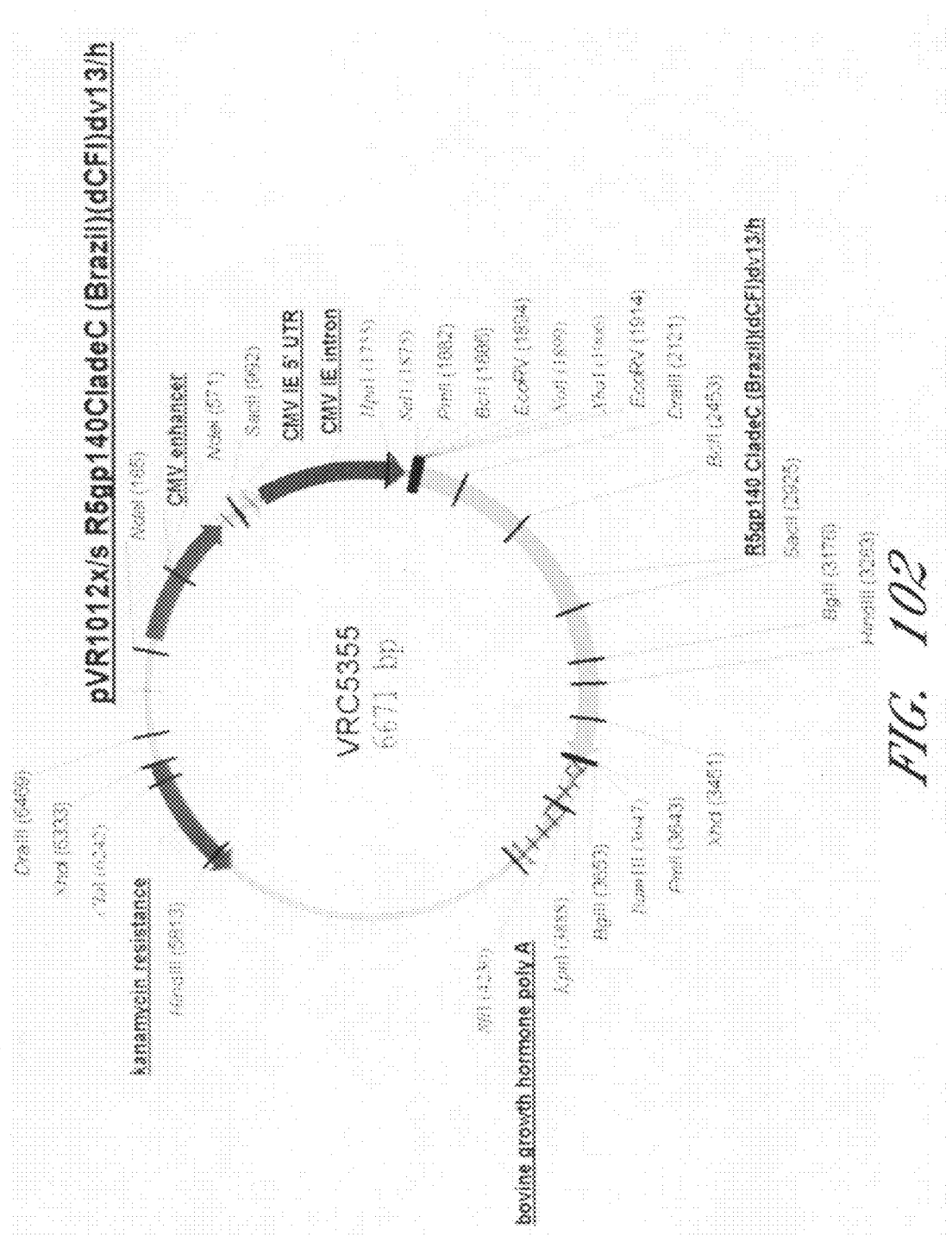
FIG. 102. Plasmid 5355.
Figure 103:
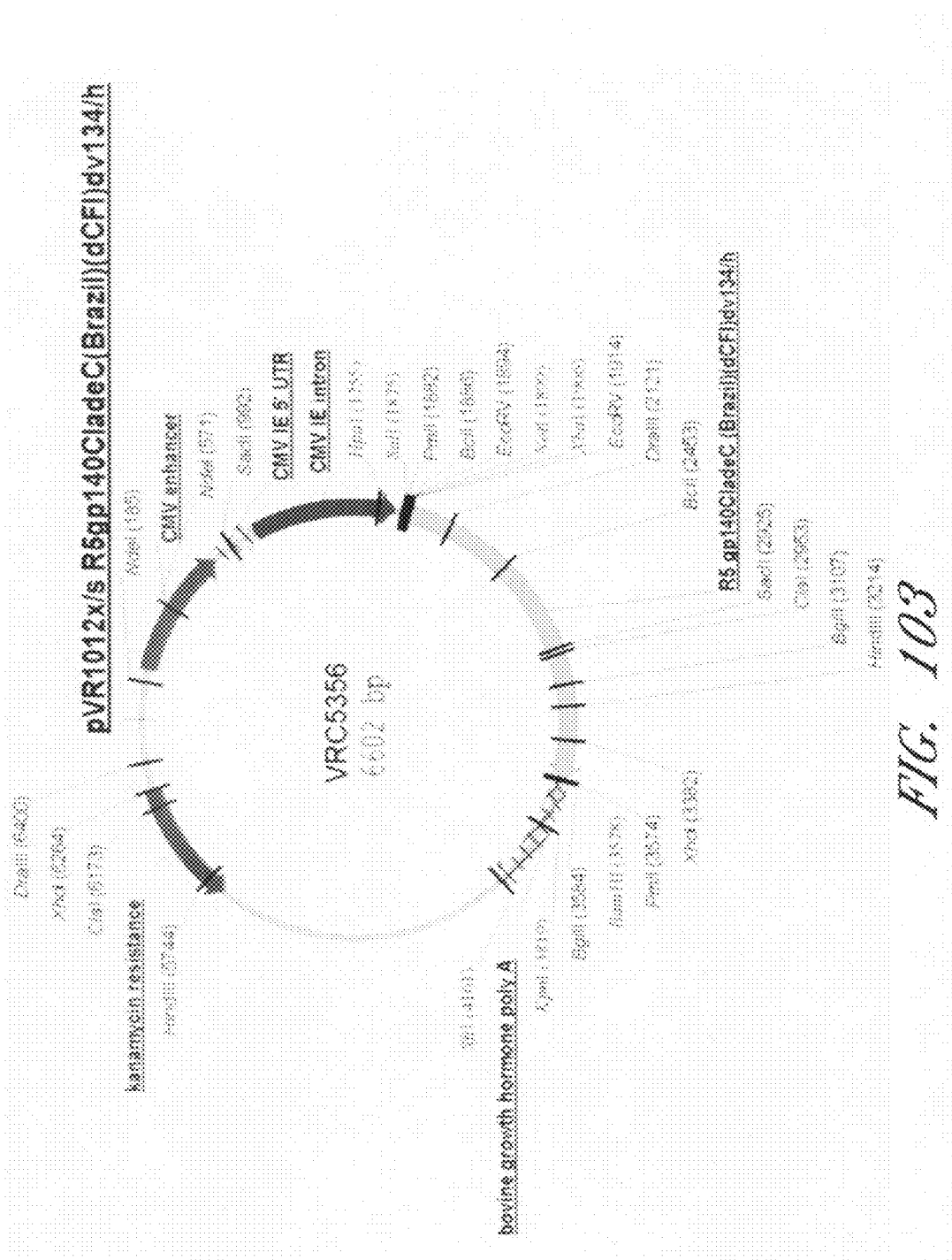
FIG. 103. Plasmid 5356.
Figure 104:
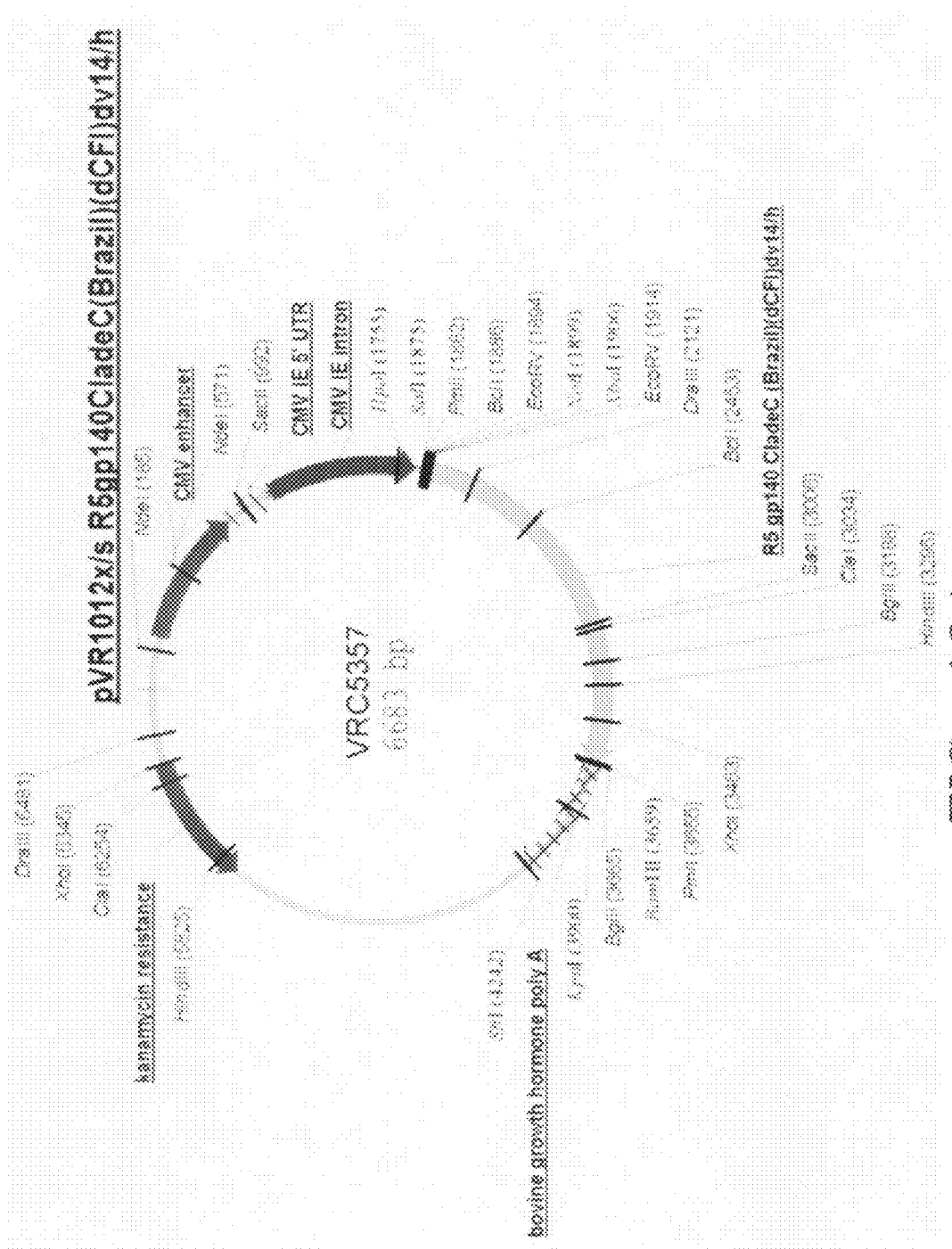
FIG. 104. Plasmid 5357.
Figure 105:
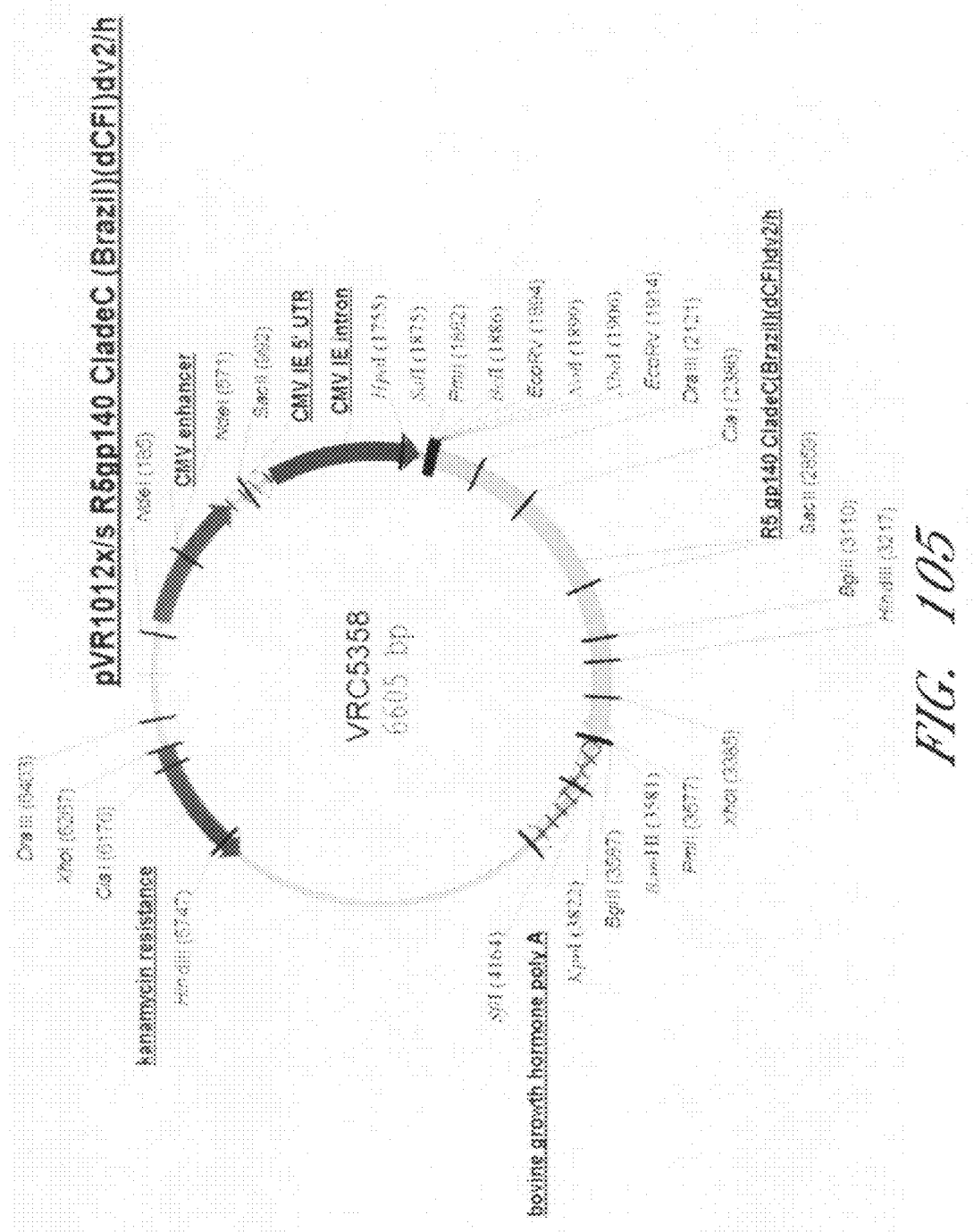
FIG. 105. Plasmid 5358.
Figure 106:
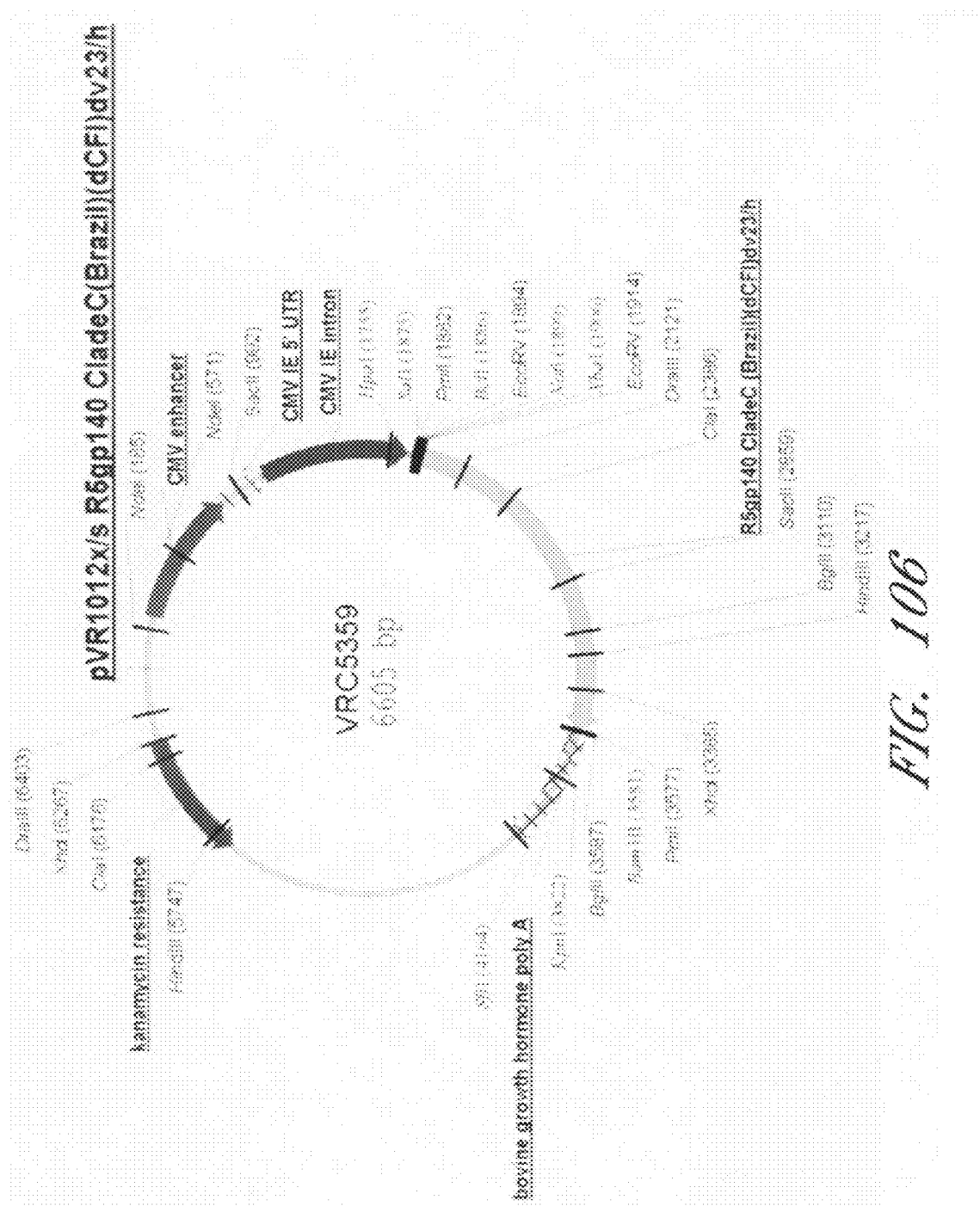
FIG. 106. Plasmid 5359.
Figure 107:
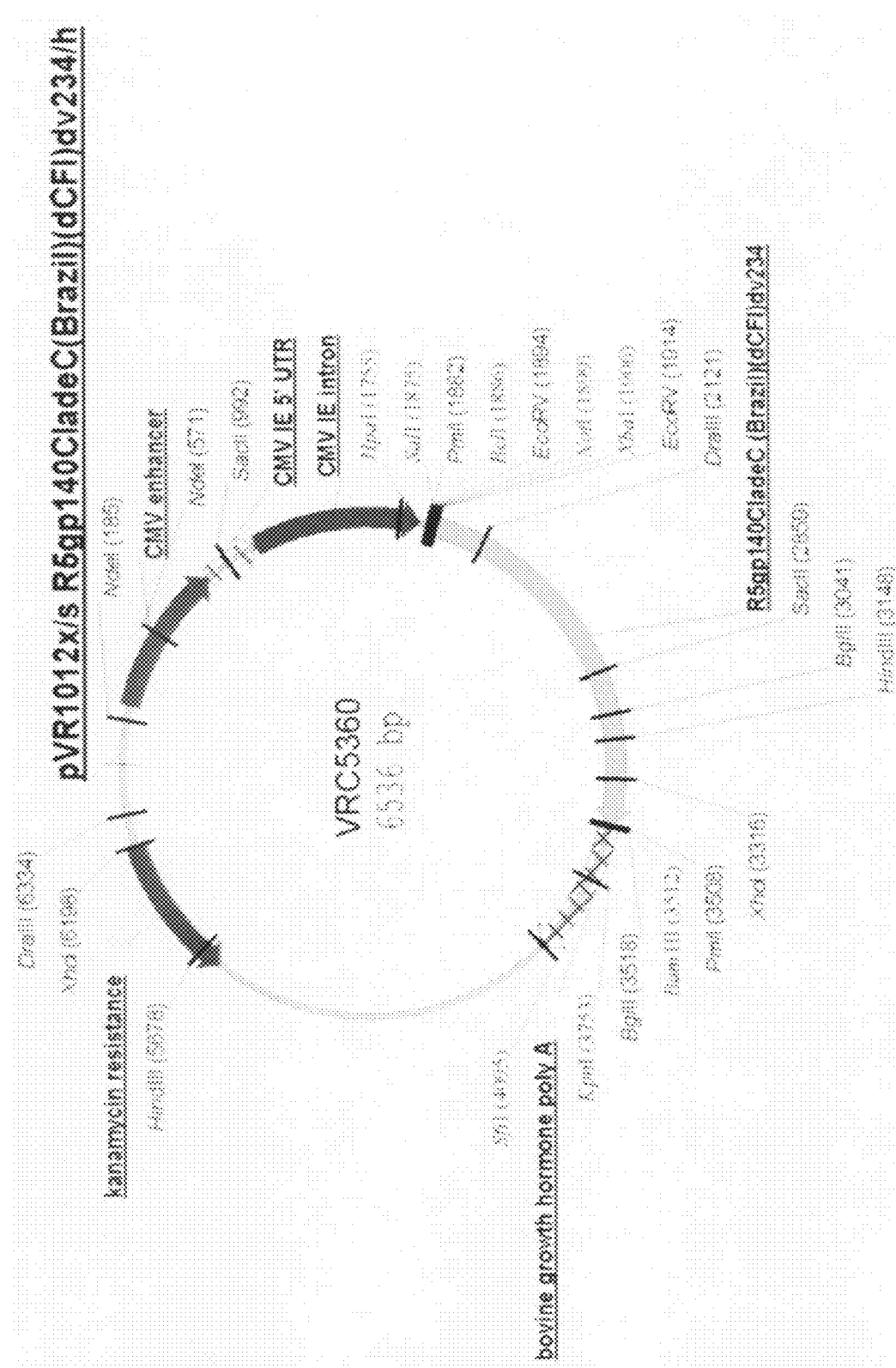
FIG. 107. Plasmid 5360.
Figure 108:
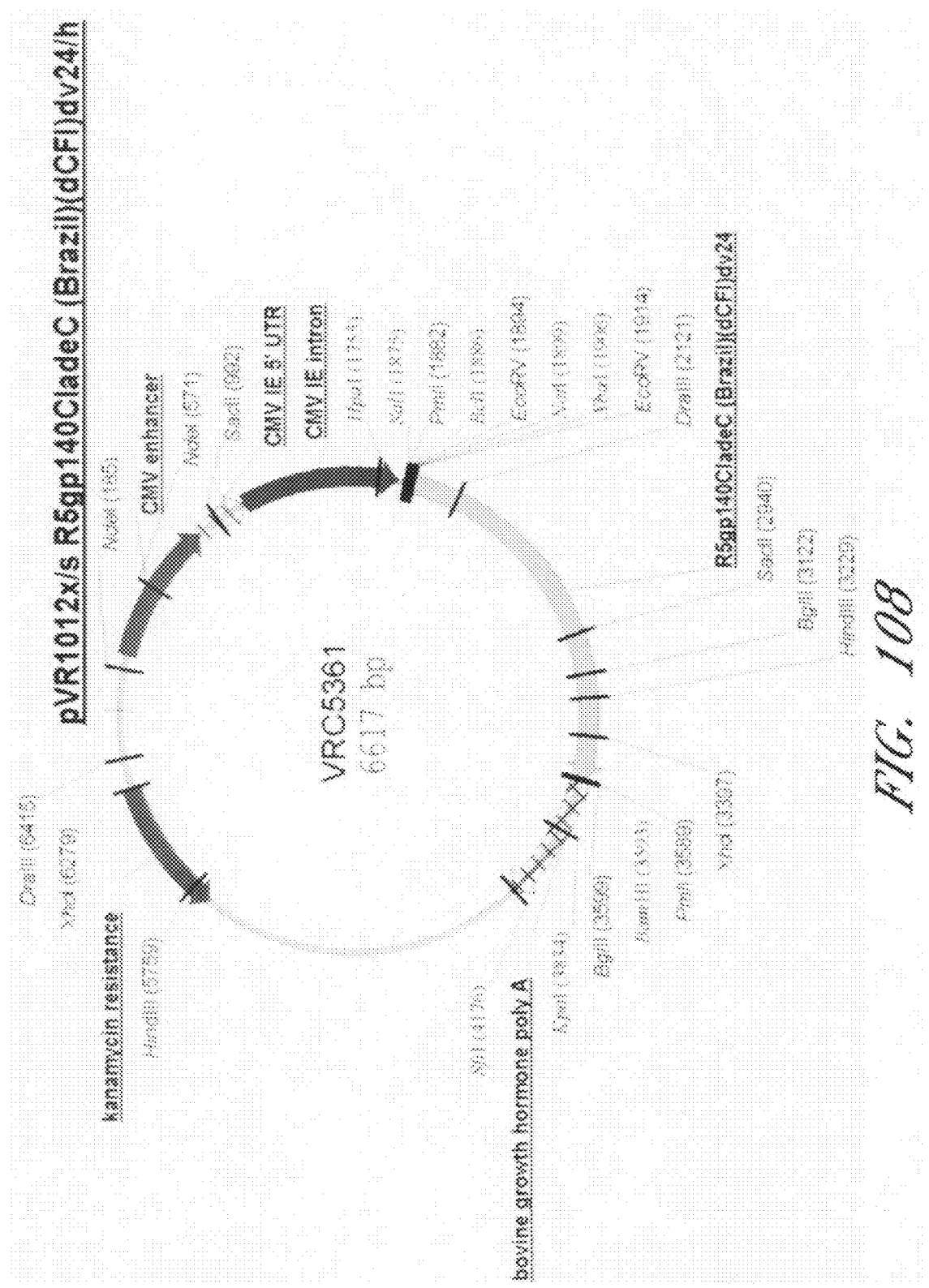
FIG. 108. Plasmid 5361.
Figure 109:
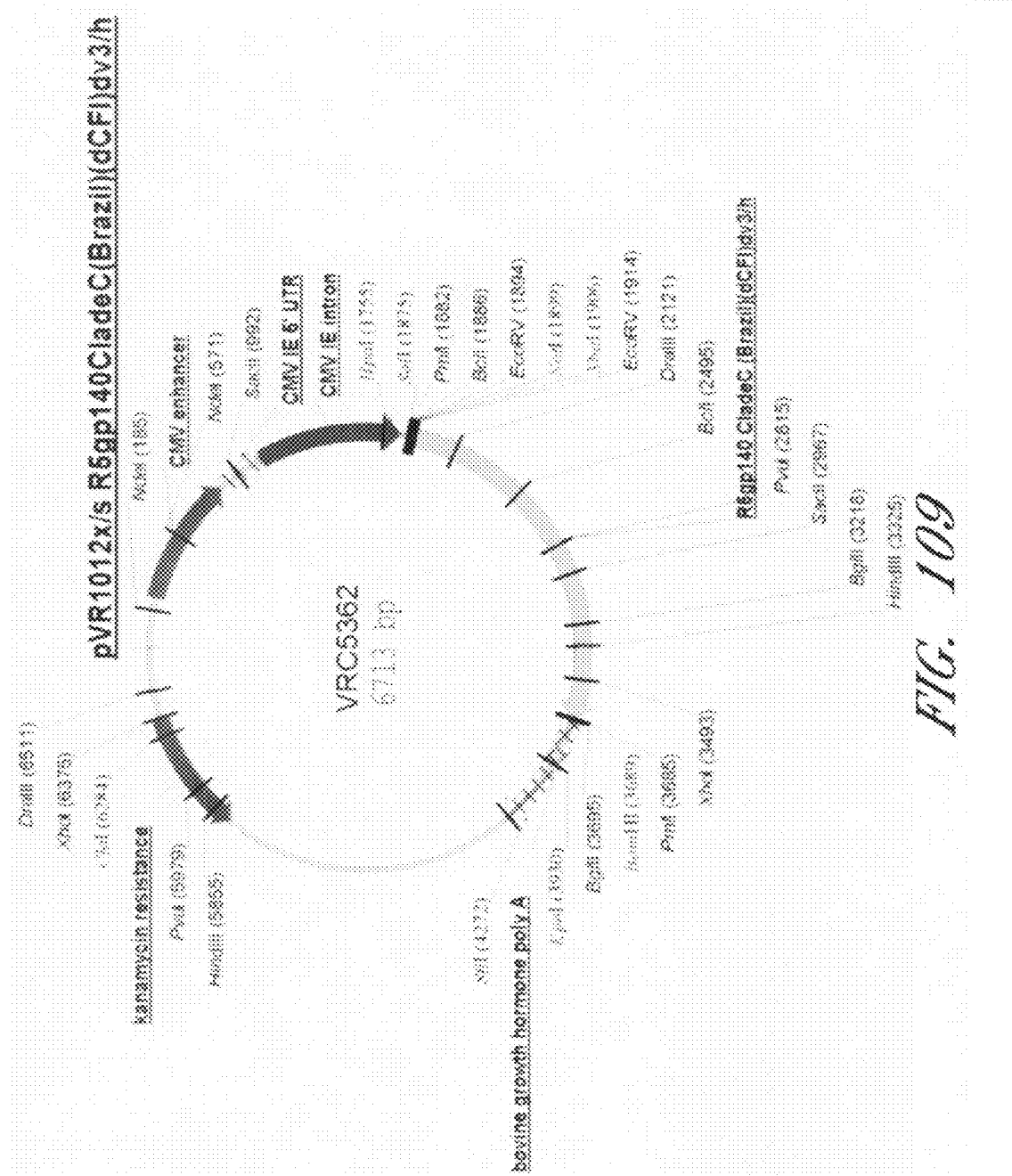
FIG. 109. Plasmid 5362.
Figure 110:
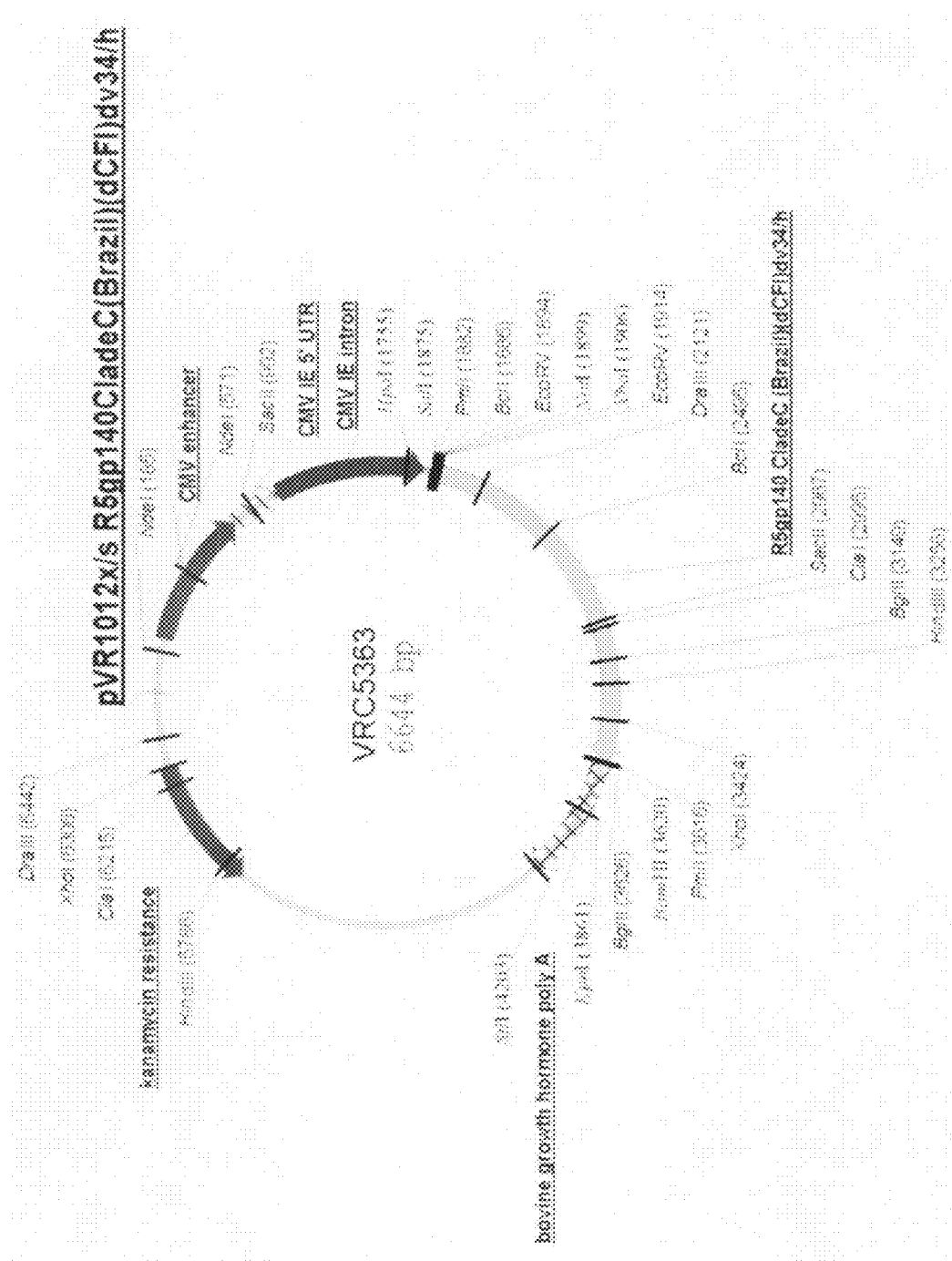
FIG. 110. Plasmid 5363.
Figure 111:
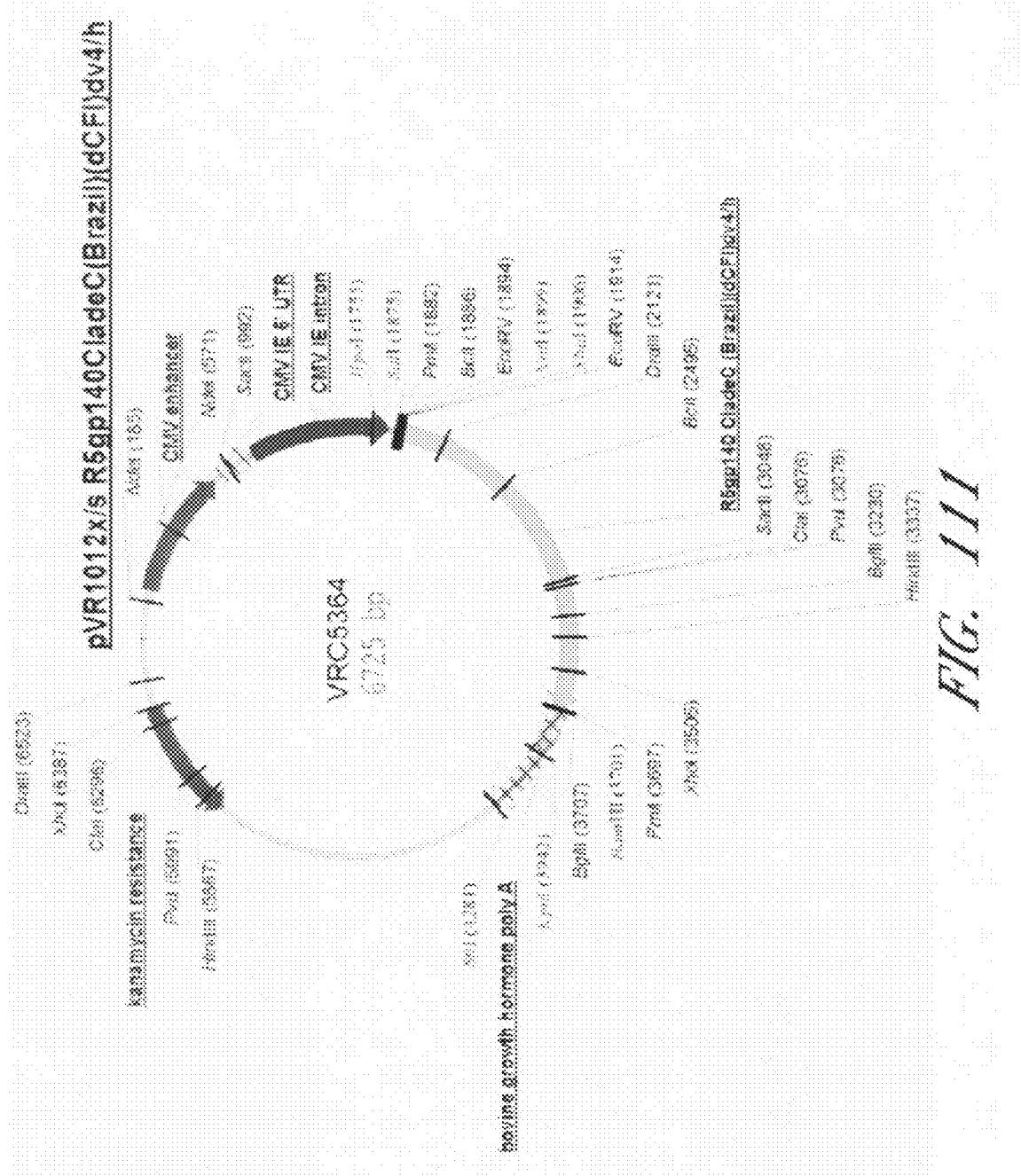
FIG. 111. Plasmid 5364.
Figure 112:
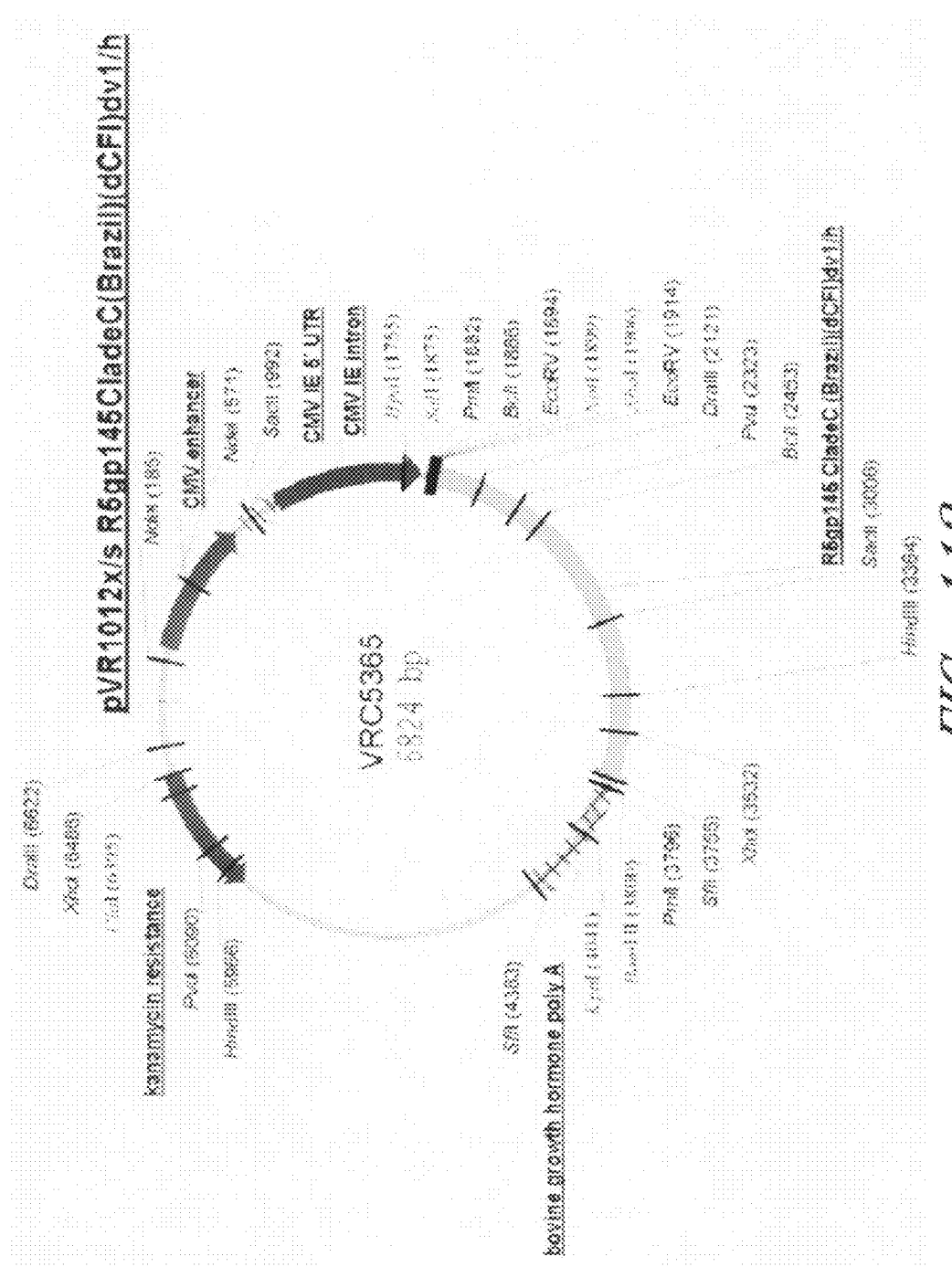
FIG. 112. Plasmid 5365.
Figure 113:
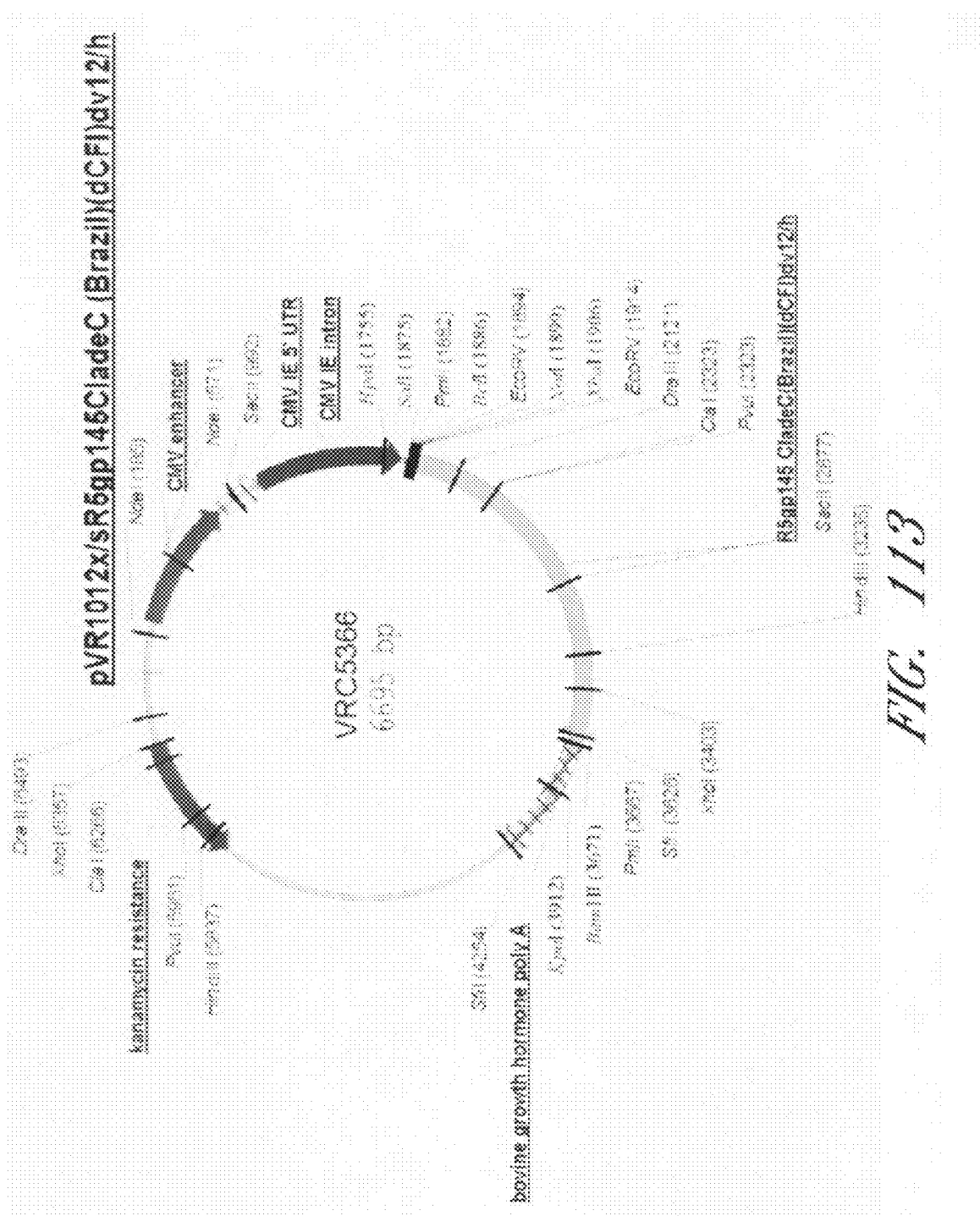
FIG. 113. Plasmid 5366.
Figure 114:
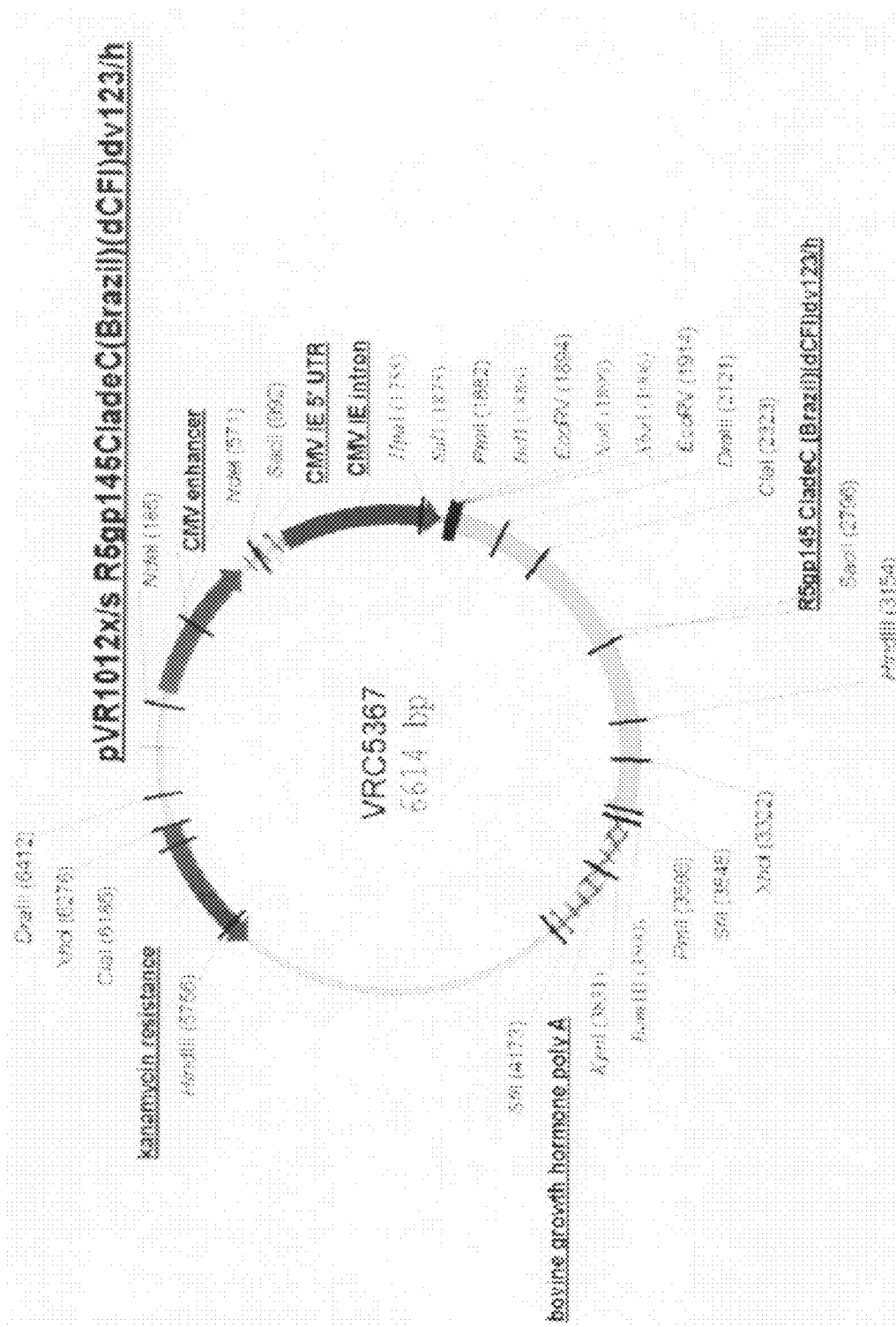
FIG. 114. Plasmid 5367.
Figure 115:
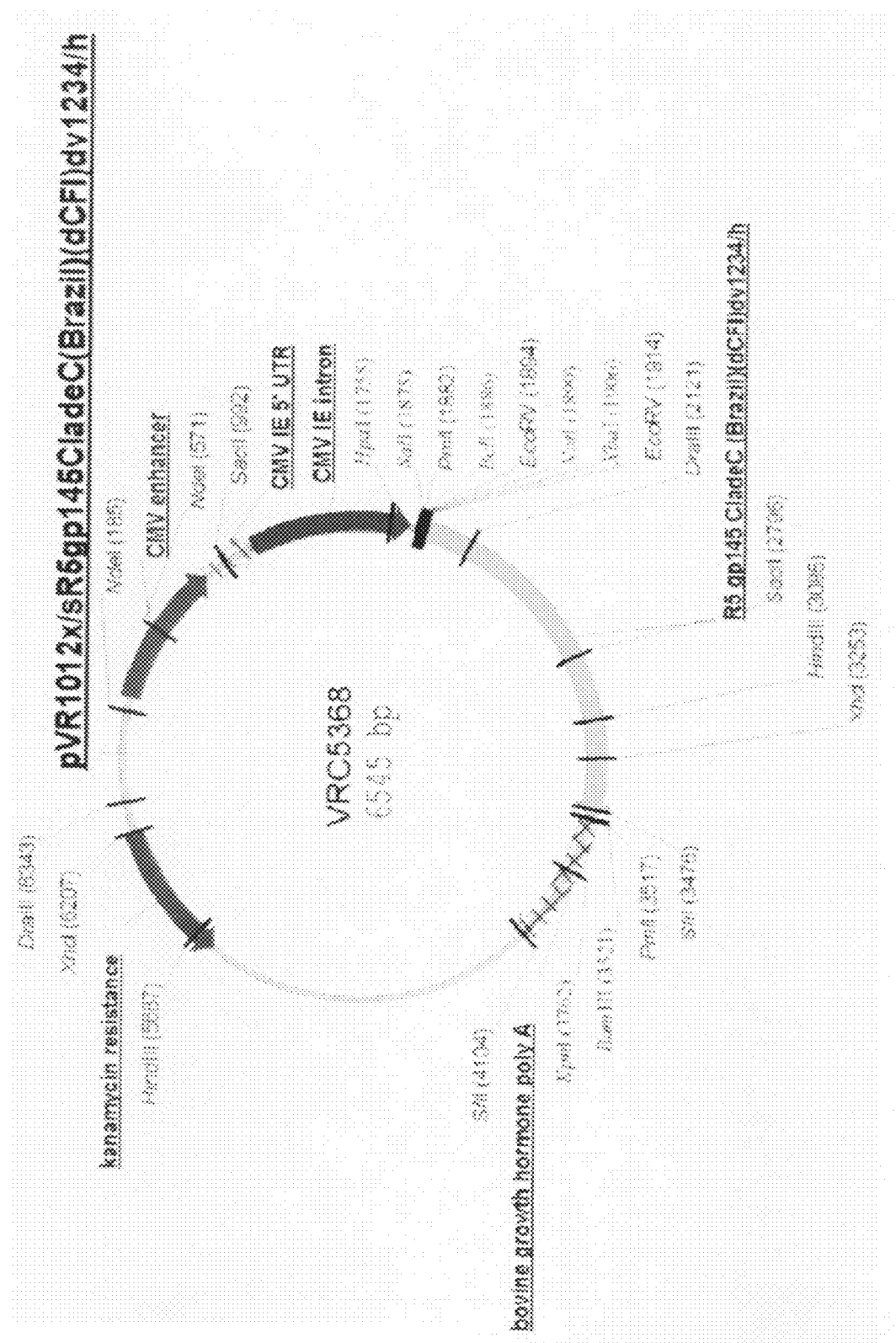
FIG. 115. Plasmid 5368.
Figure 116:
FIG. 116. Plasmid 5369.
Figure 117:
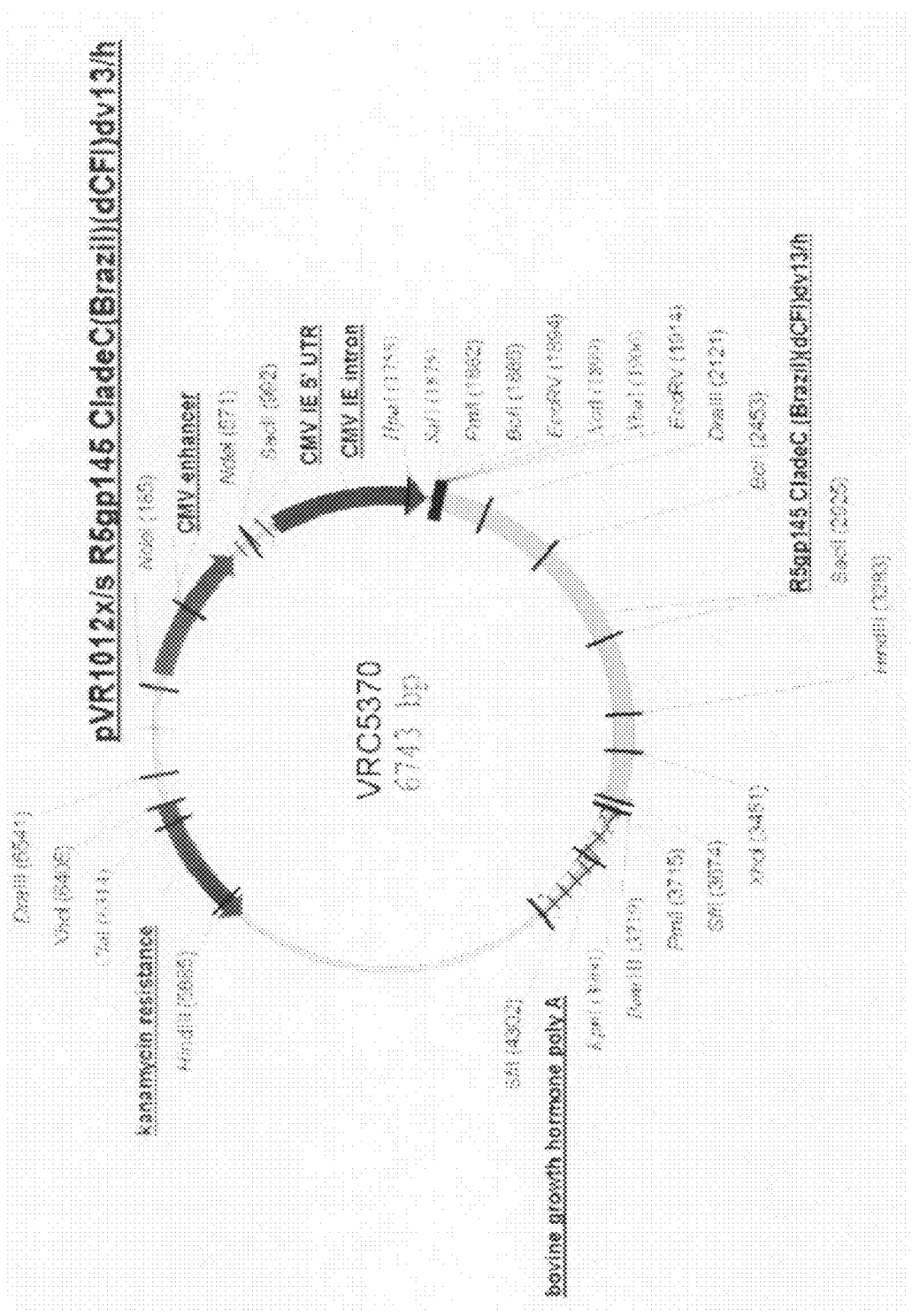
FIG. 117. Plasmid 5370.
Figure 118:
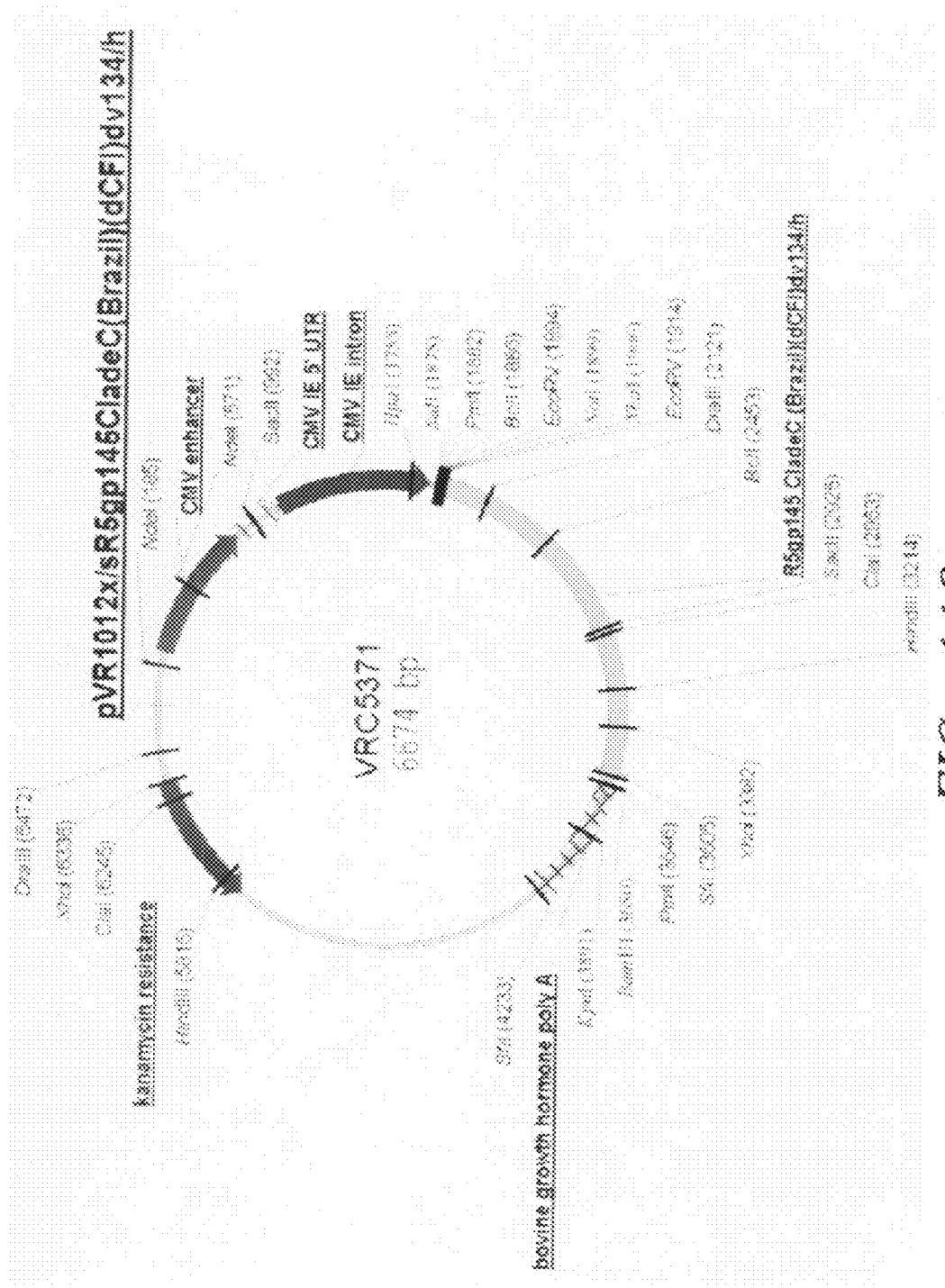
FIG. 118. Plasmid 5371.
Figure 119:
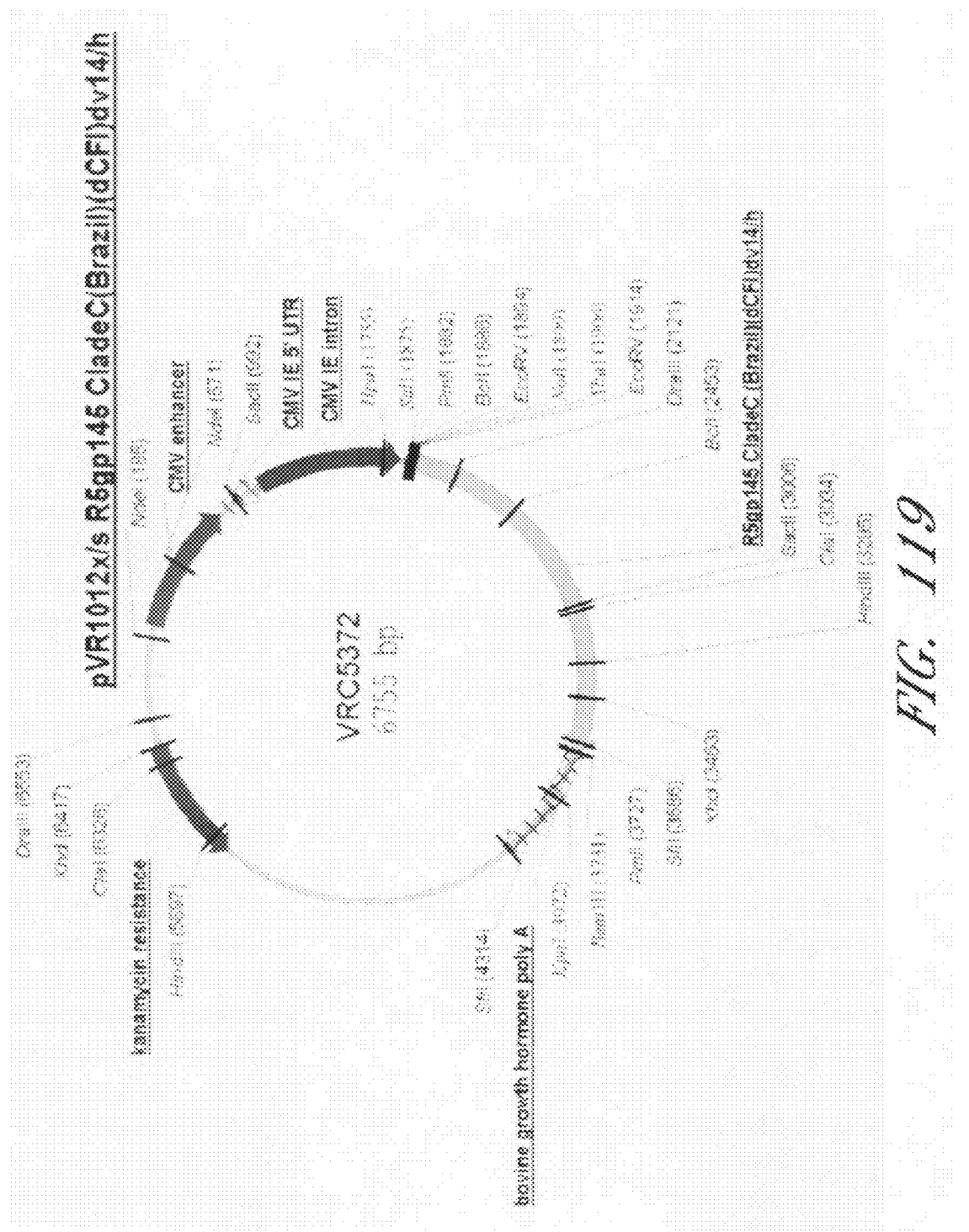
FIG. 119. Plasmid 5372.
Figure 120:
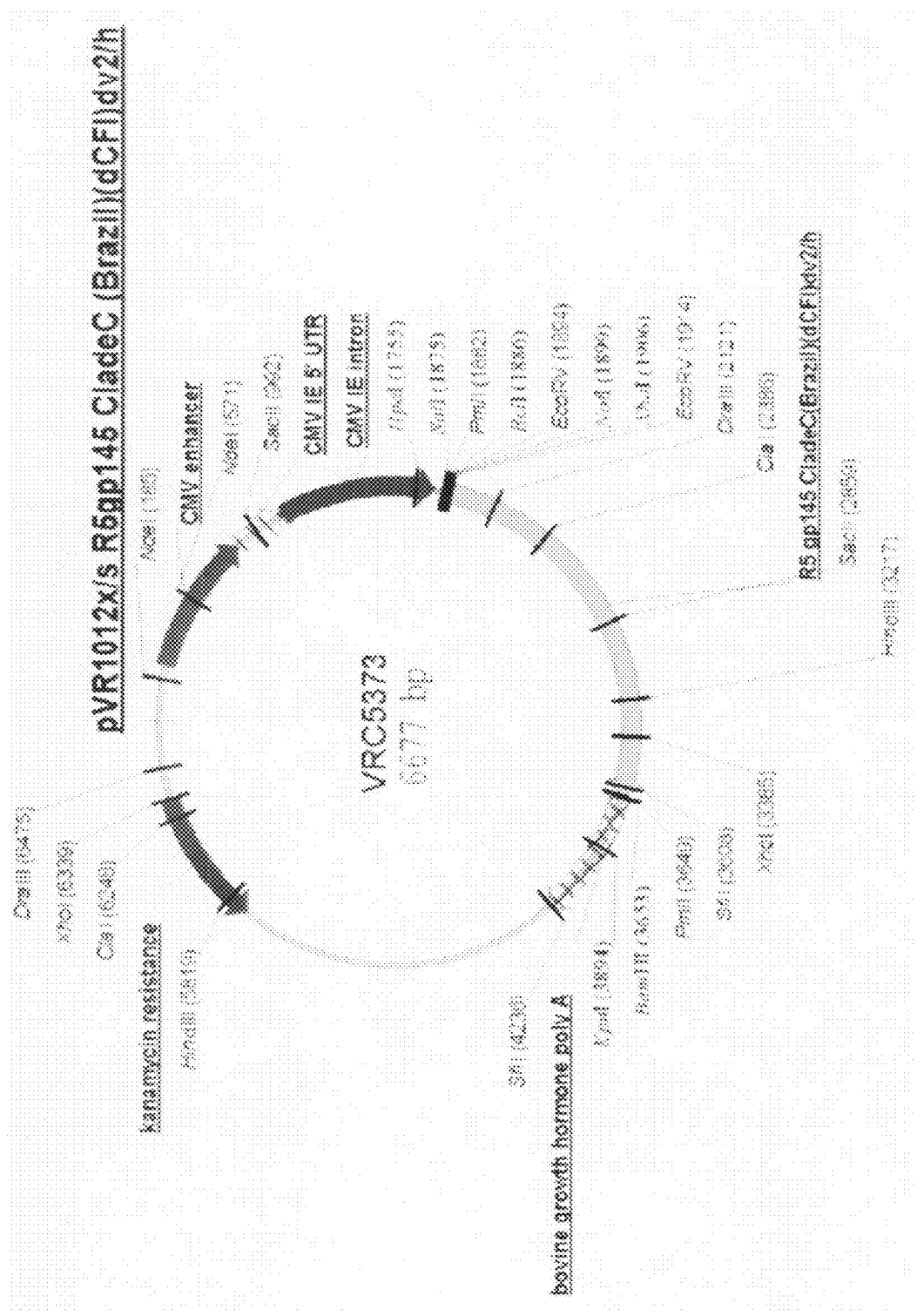
FIG. 120. Plasmid 5373.
Figure 121:
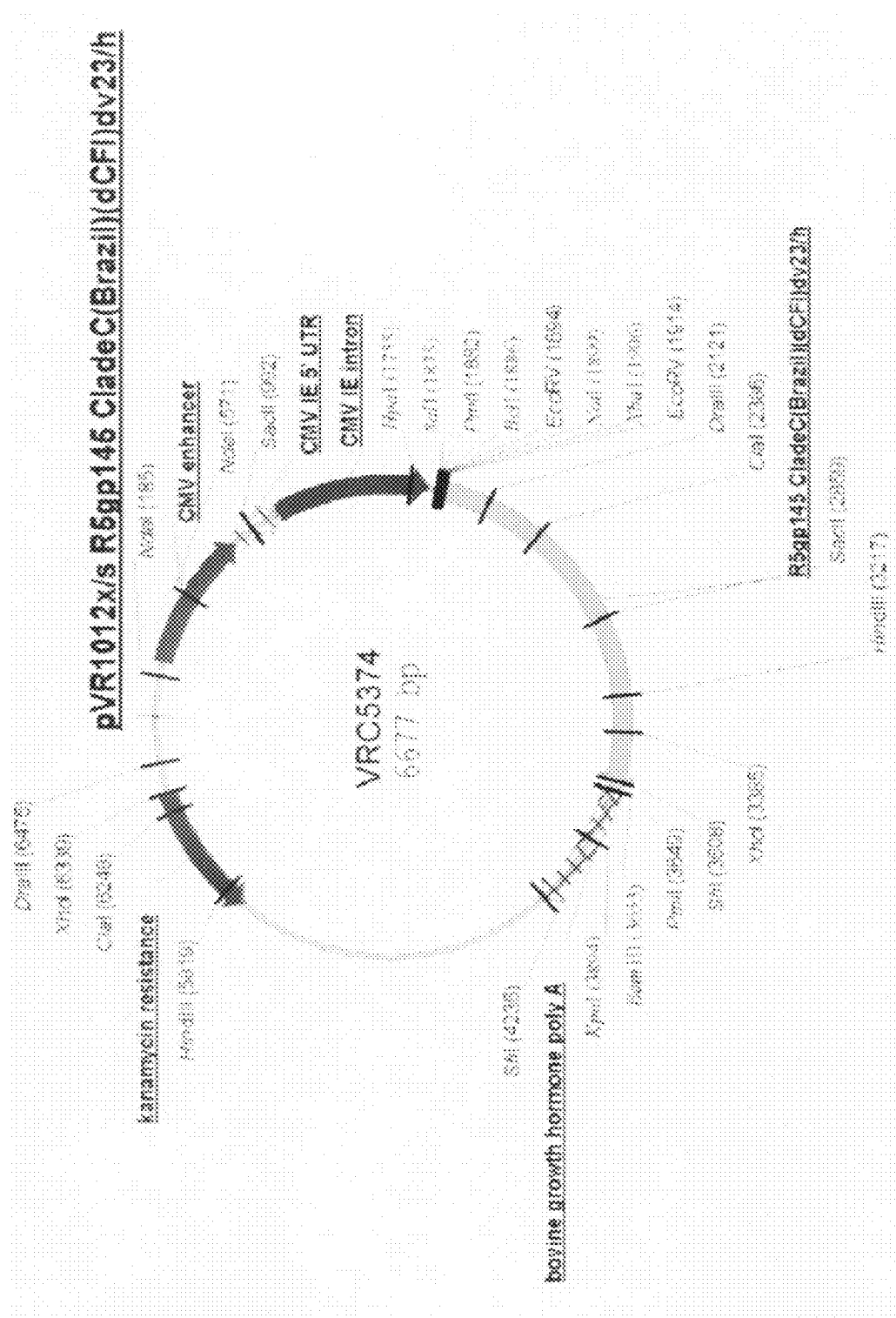
FIG. 121. Plasmid 5374.
Figure 122:
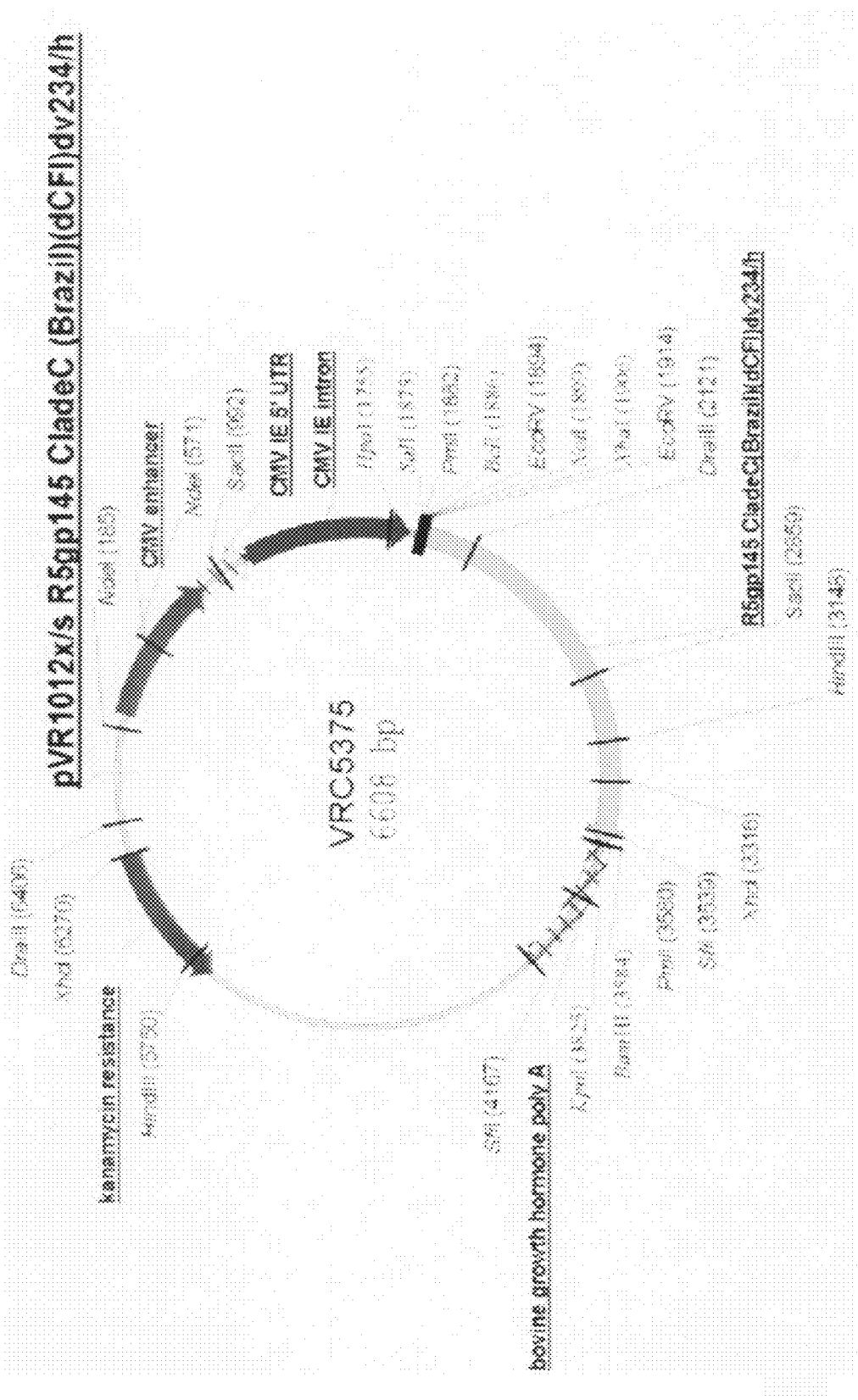
FIG. 122. Plasmid 5375.
Figure 123:
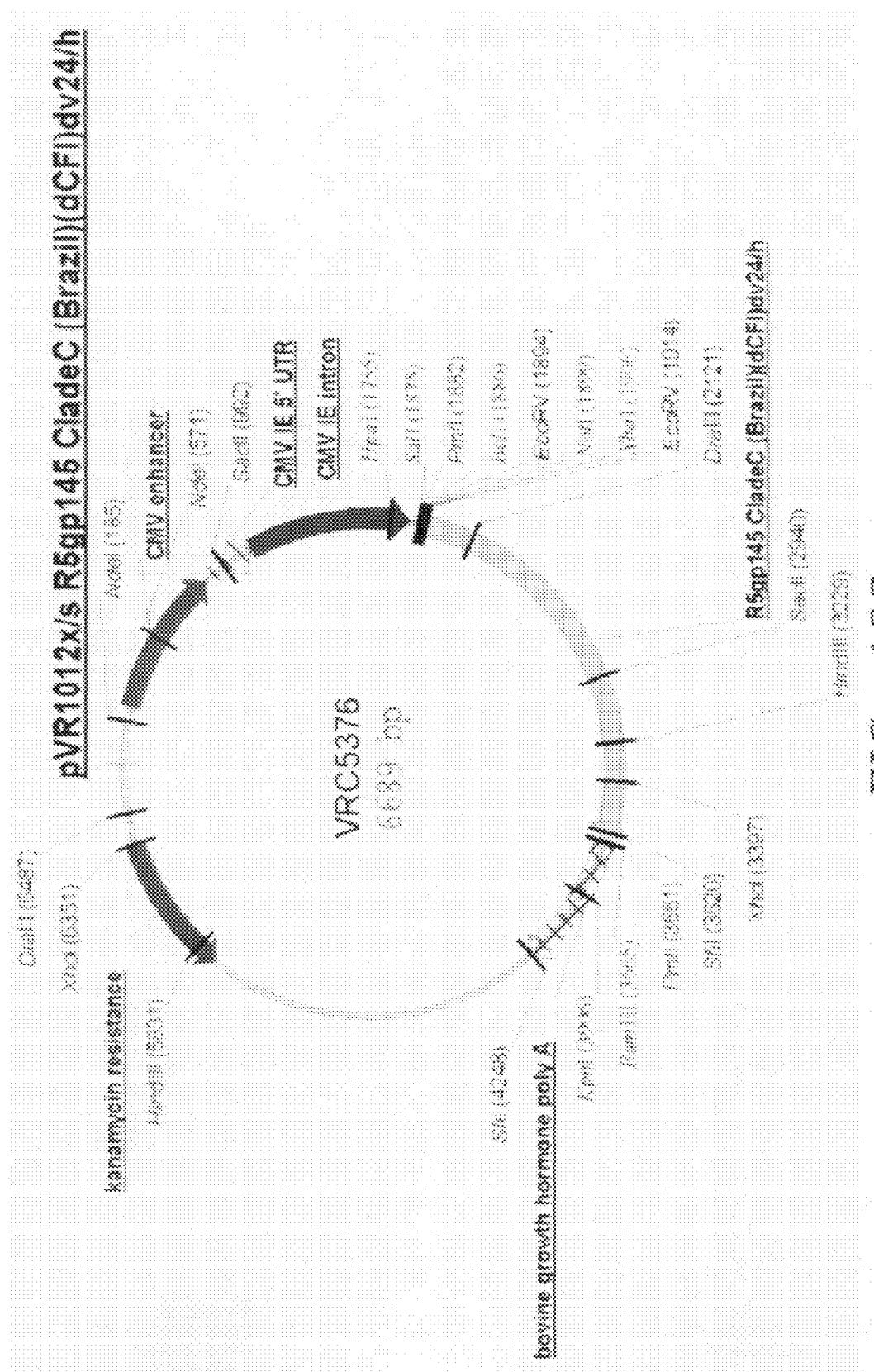
FIG. 123. Plasmid 5376.
Figure 124:
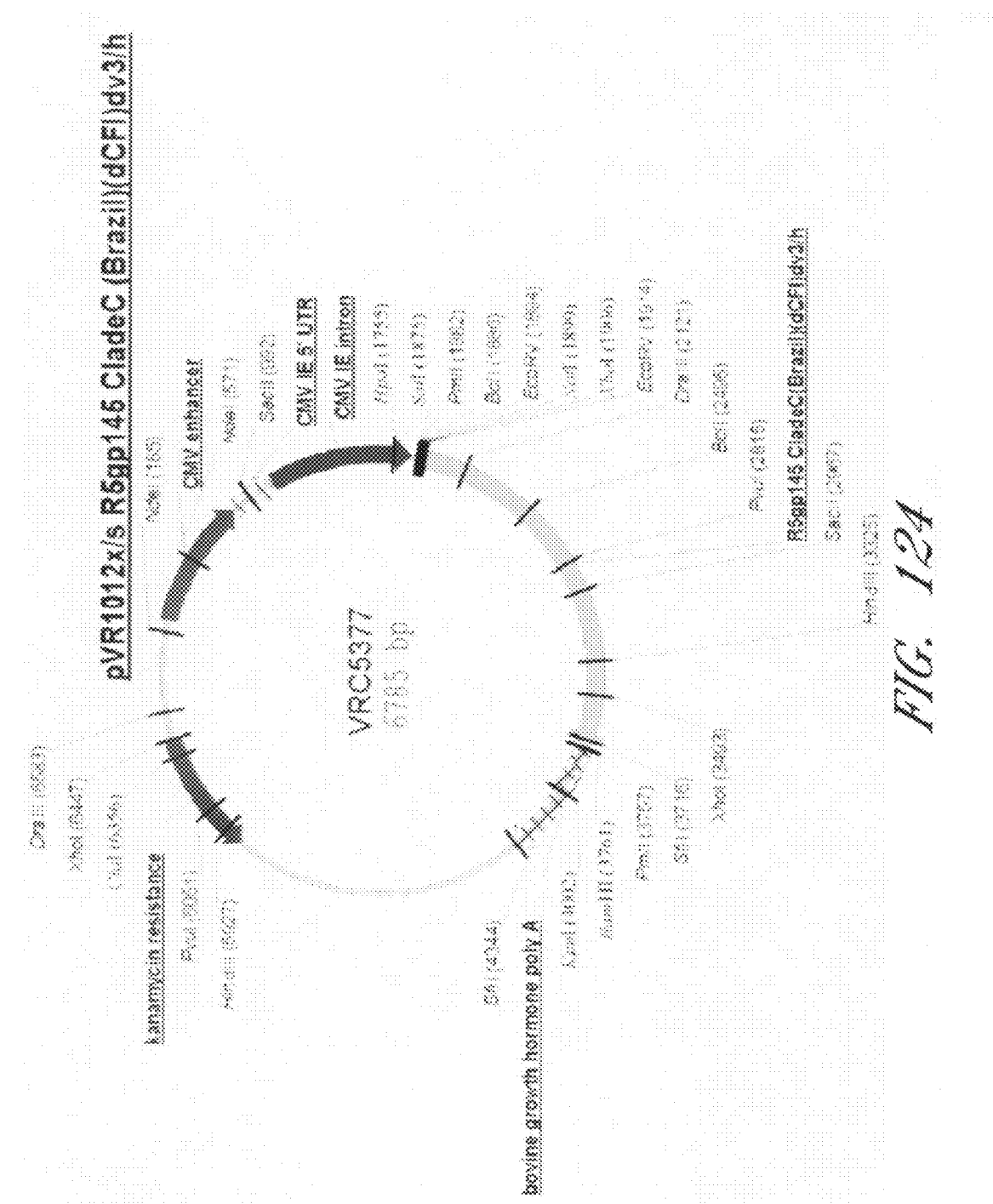
FIG. 124. Plasmid 5377.
Figure 125:
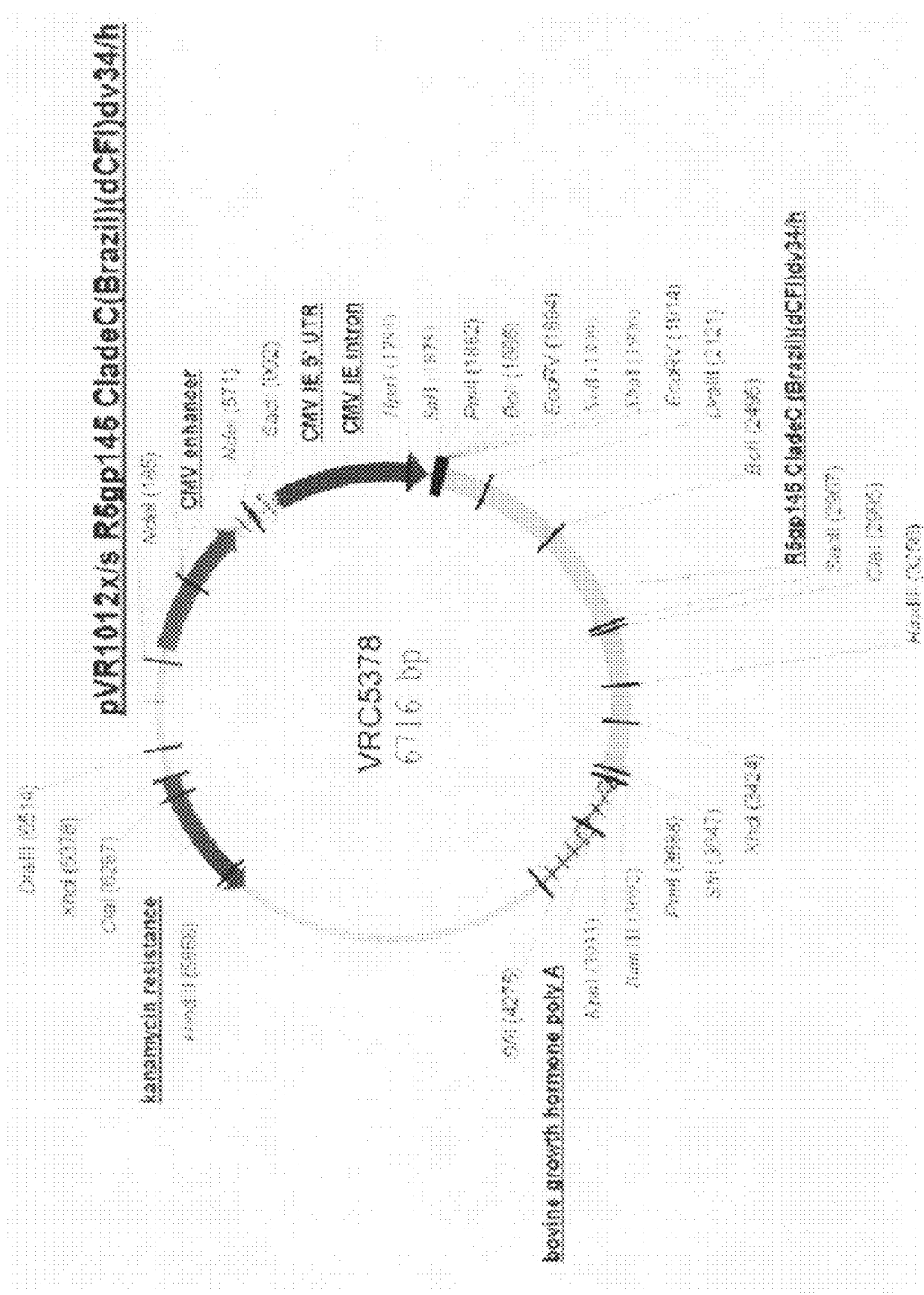
FIG. 125. Plasmid 5378.
Figure 126:
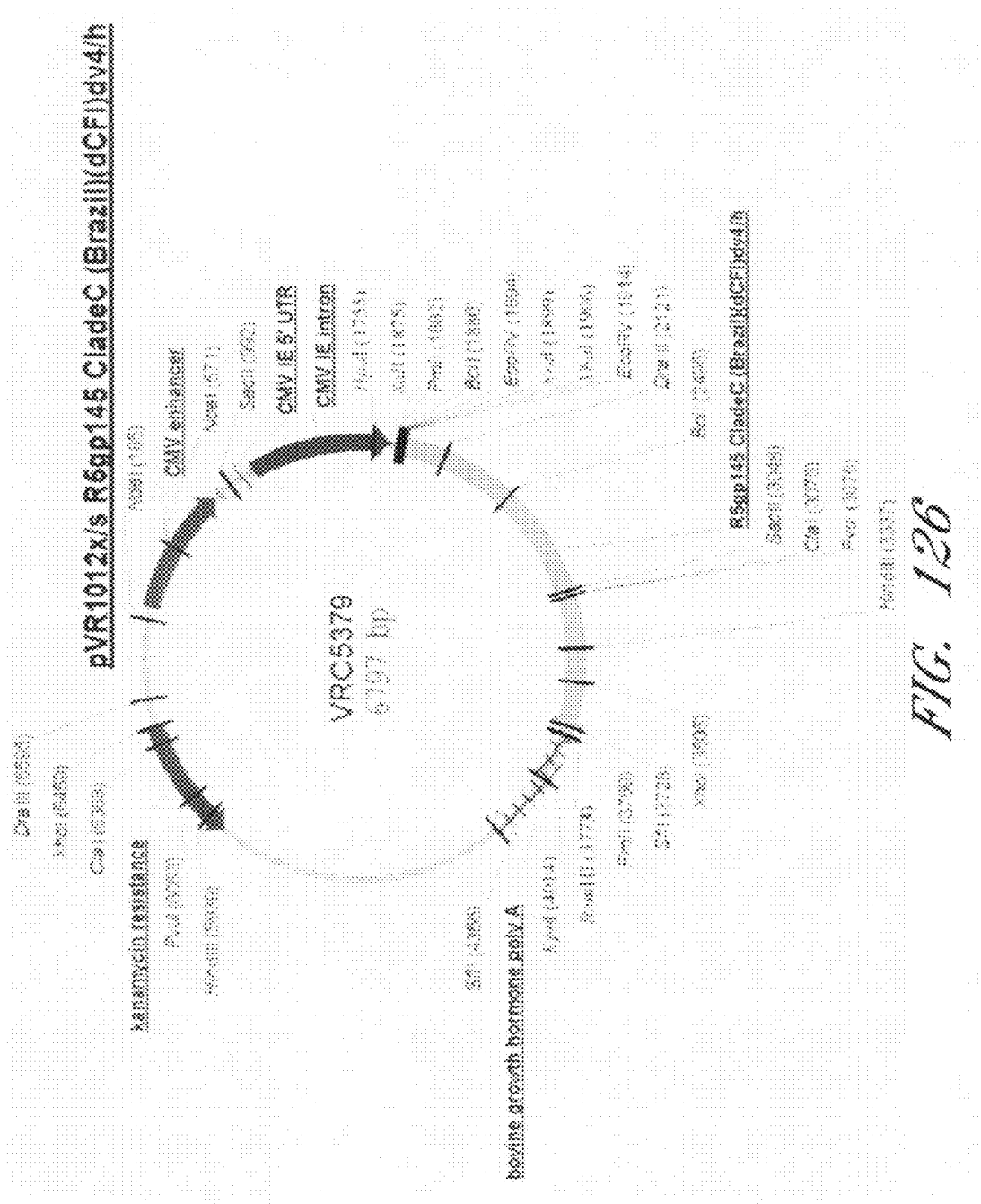
FIG. 126. Plasmid 5379.
Figure 127:
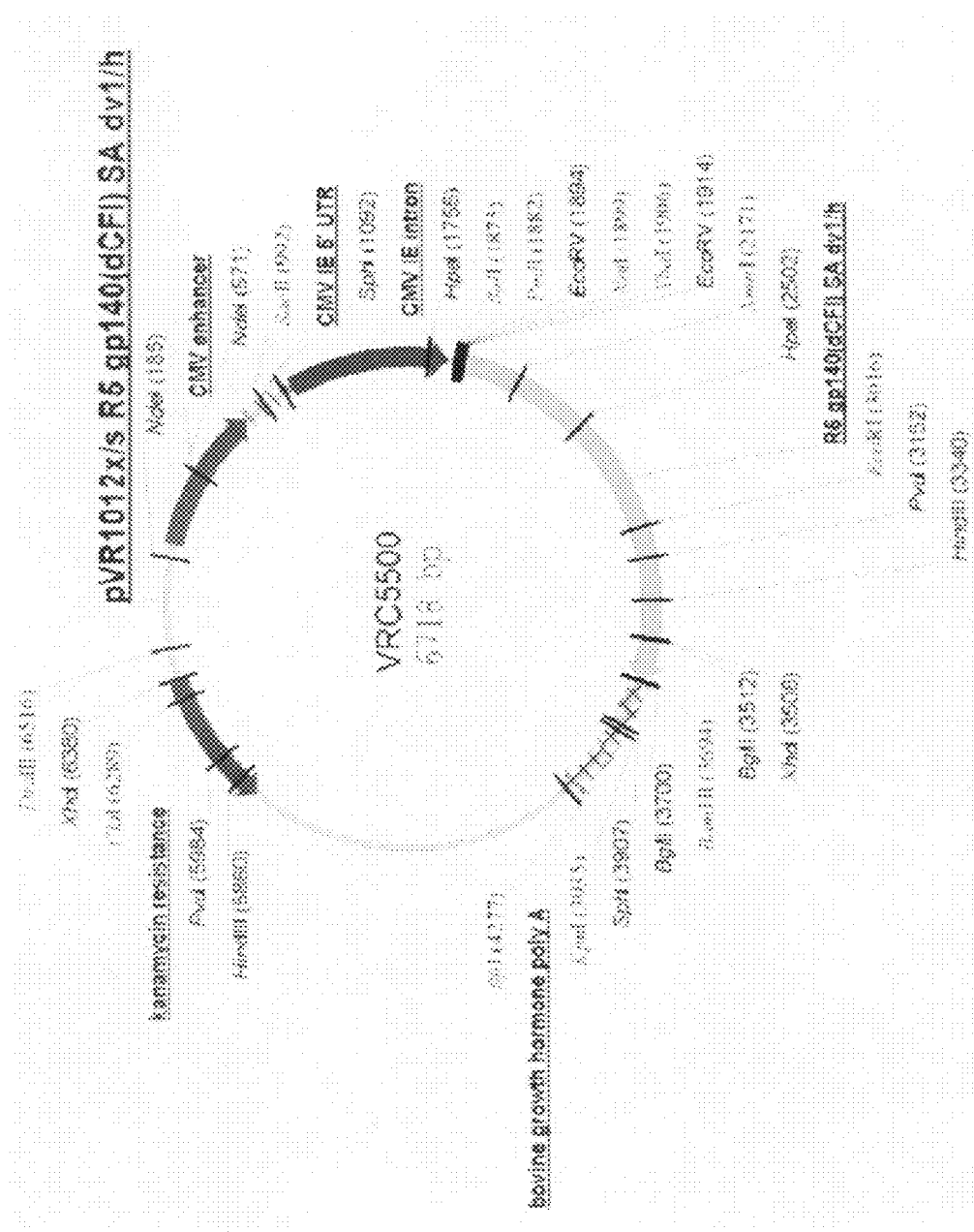
FIG. 127. Plasmid 5500.
Figure 128:
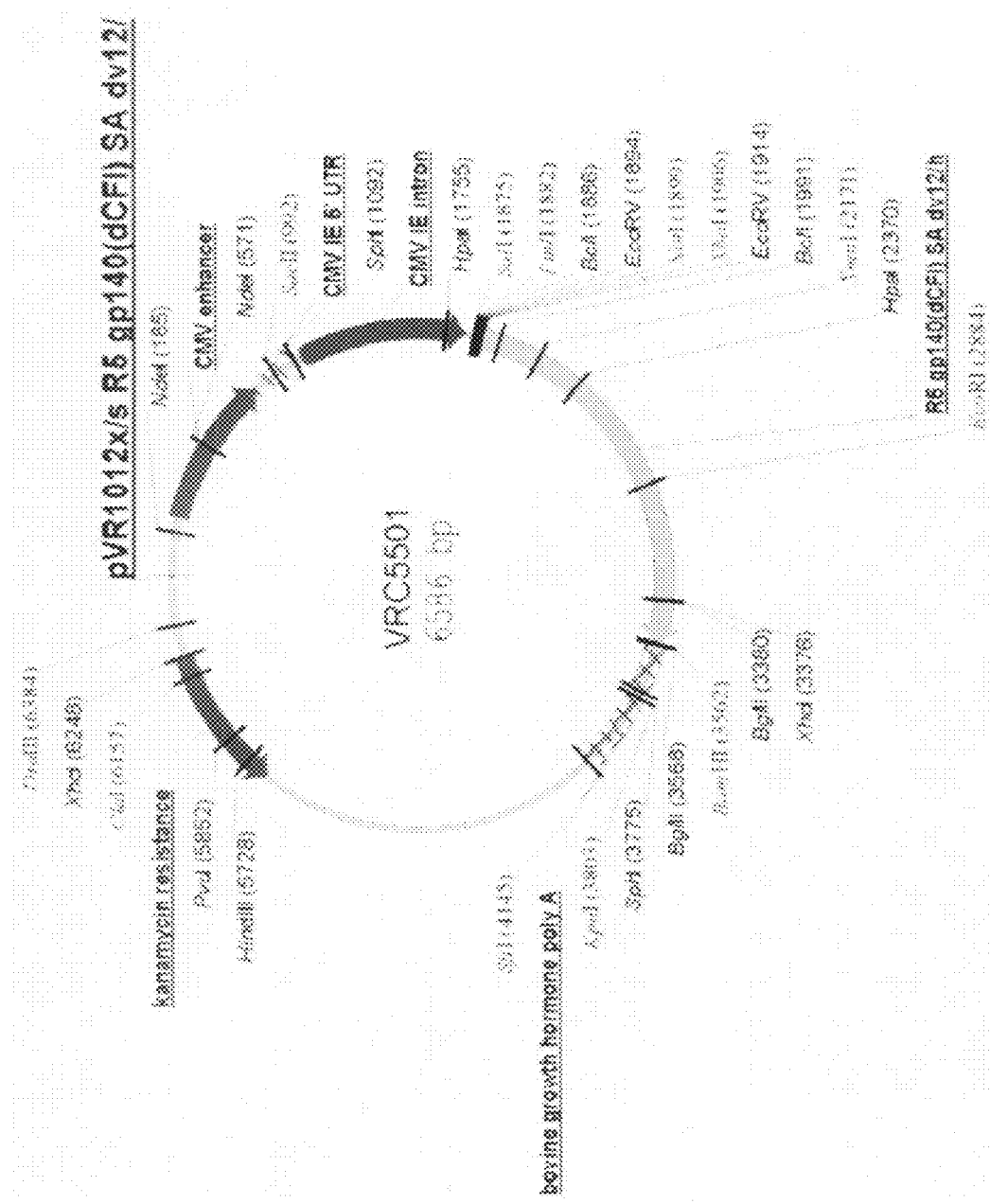
FIG. 128. Plasmid 5501.
Figure 129:
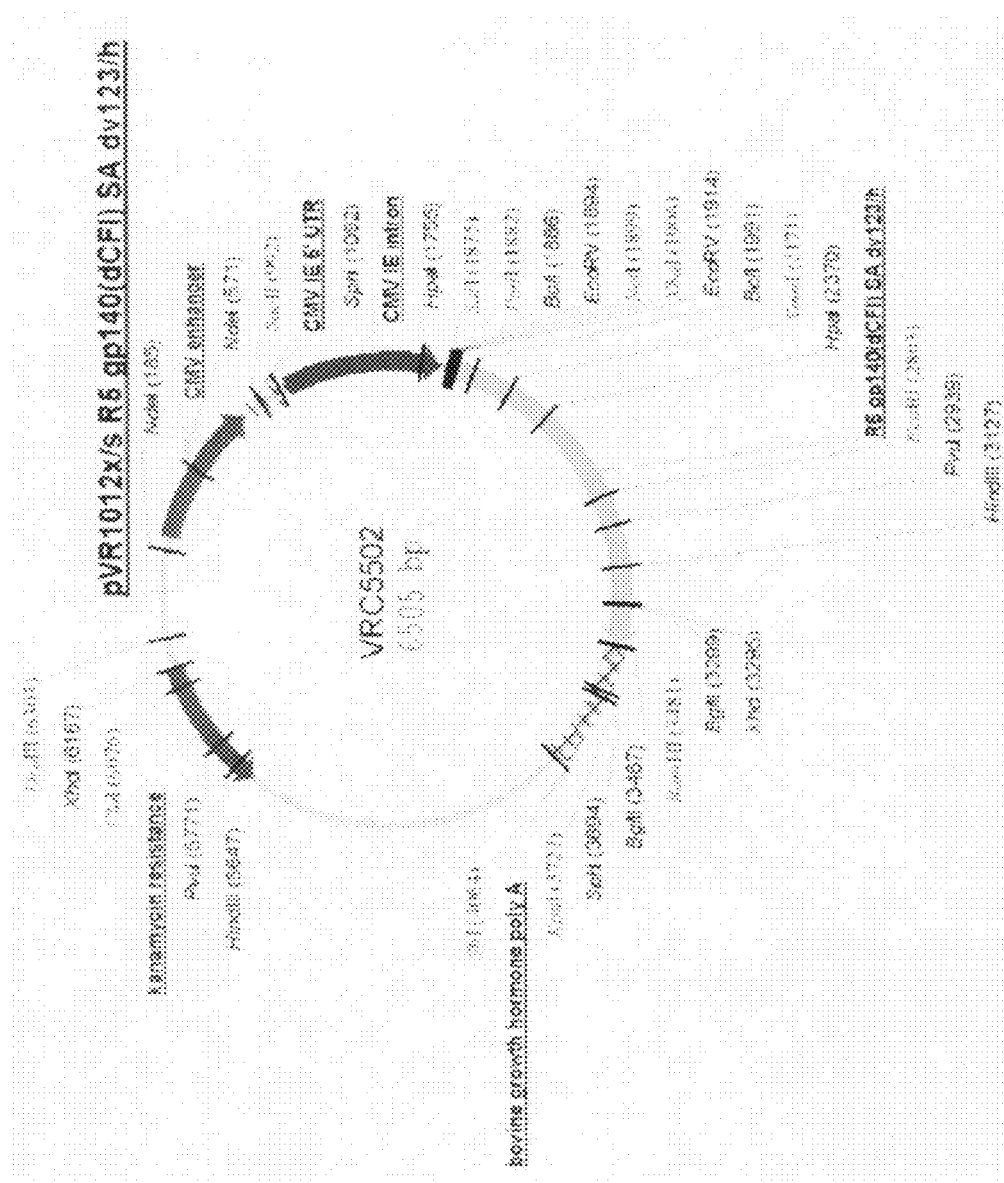
FIG. 129. Plasmid 5502.
Figure 130:
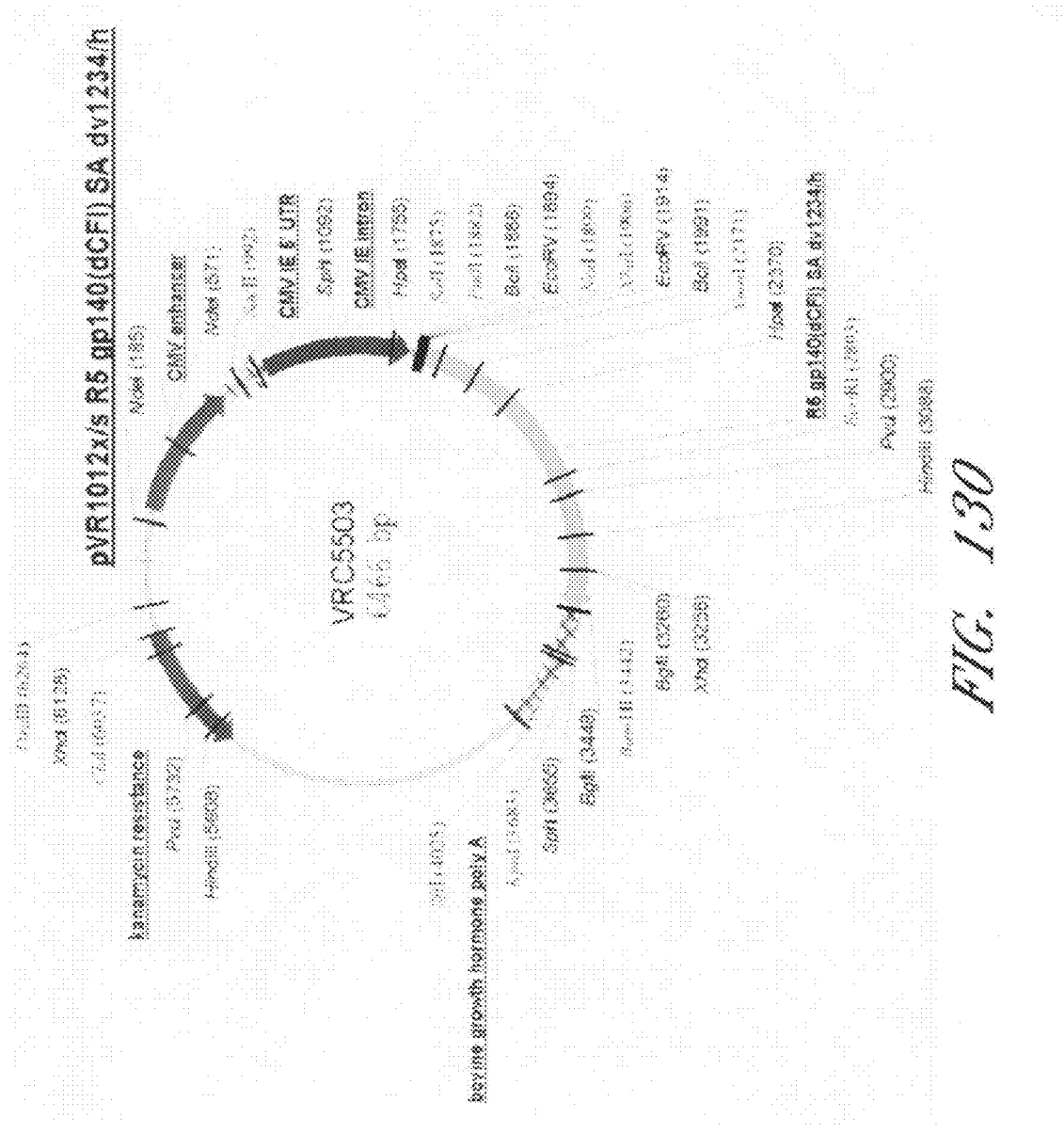
FIG. 130. Plasmid 5503.
Figure 131:
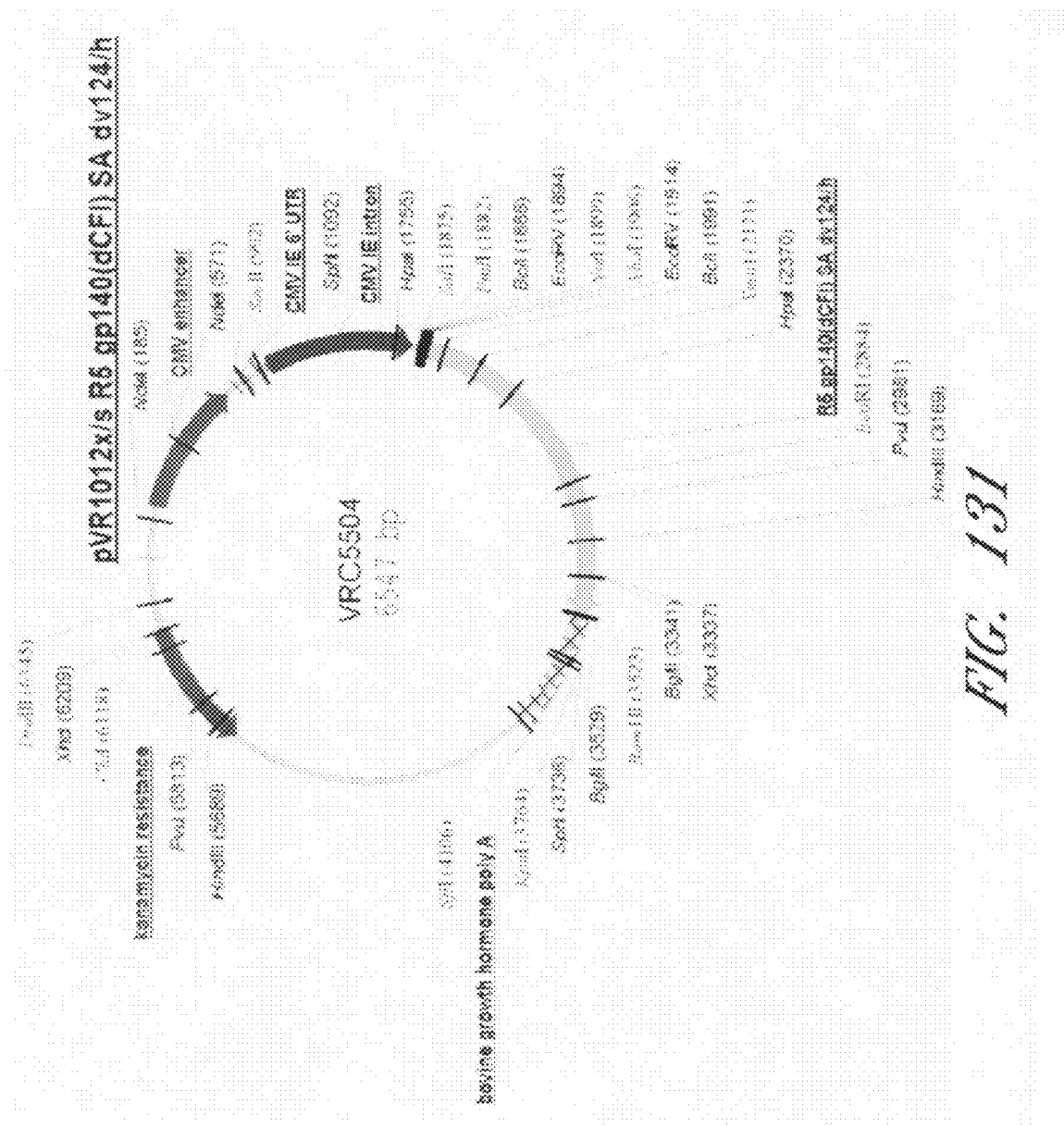
FIG. 131. Plasmid 5504.
Figure 132:
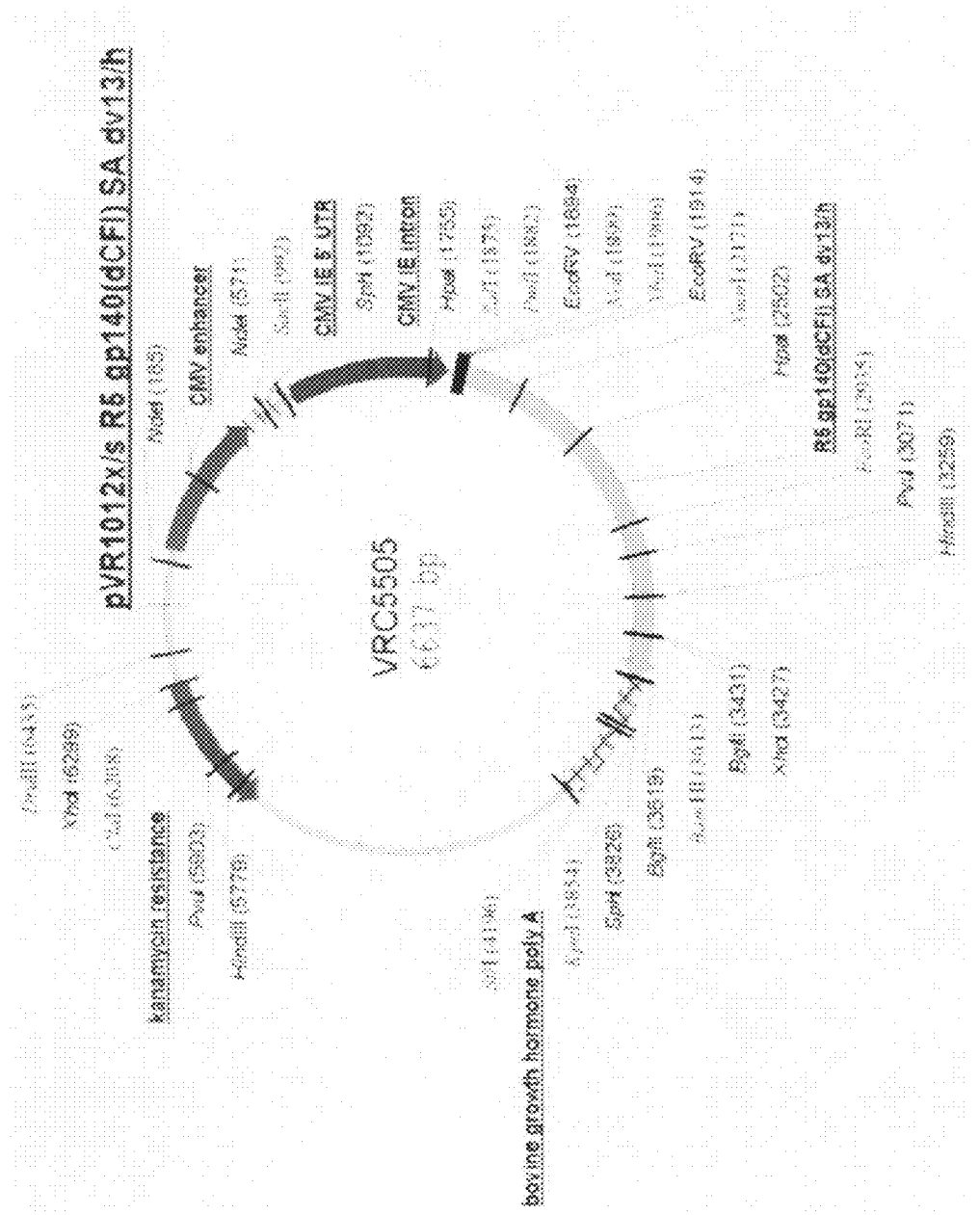
FIG. 132. Plasmid 5505.
Figure 133:
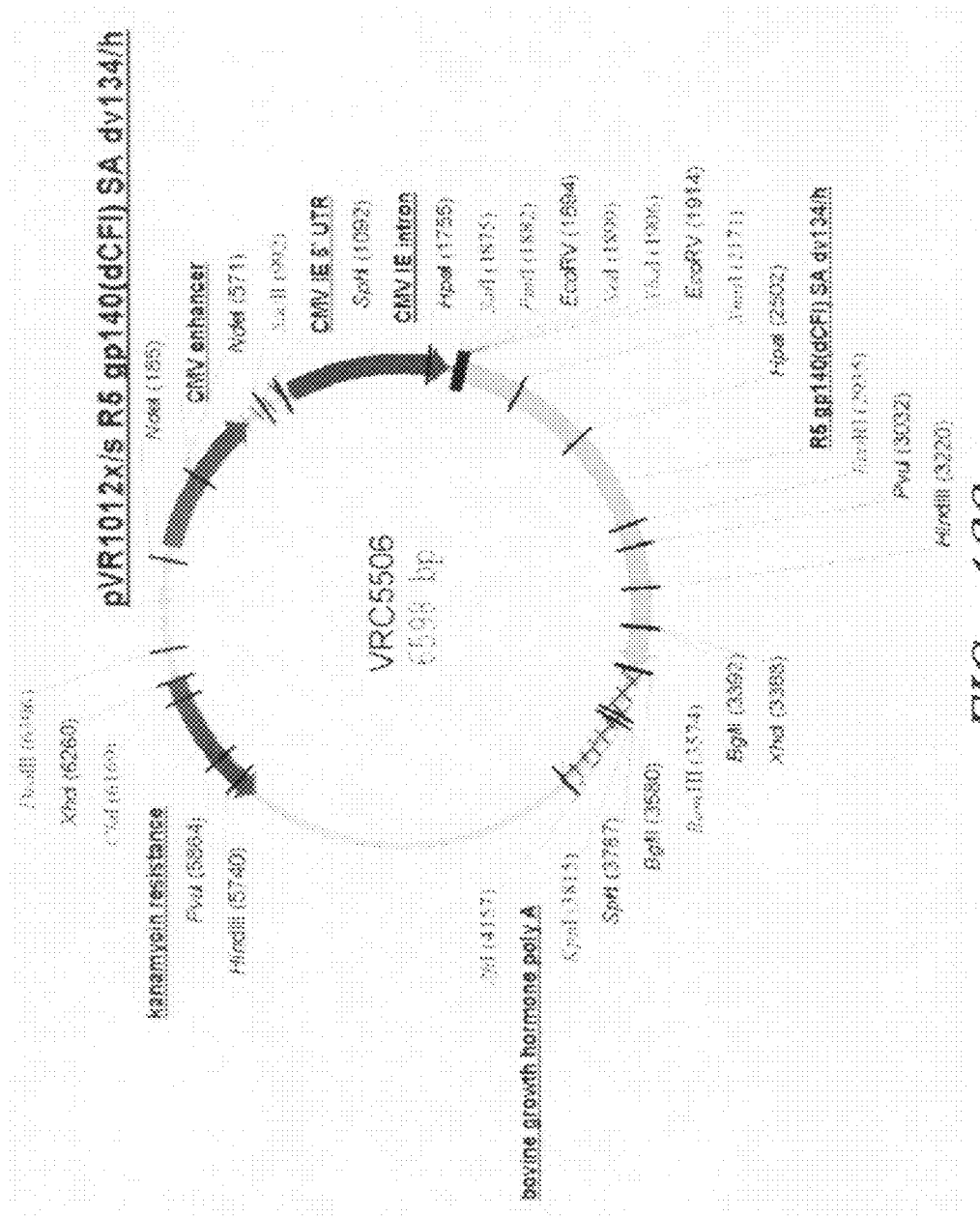
FIG. 133. Plasmid 5506.
Figure 134:
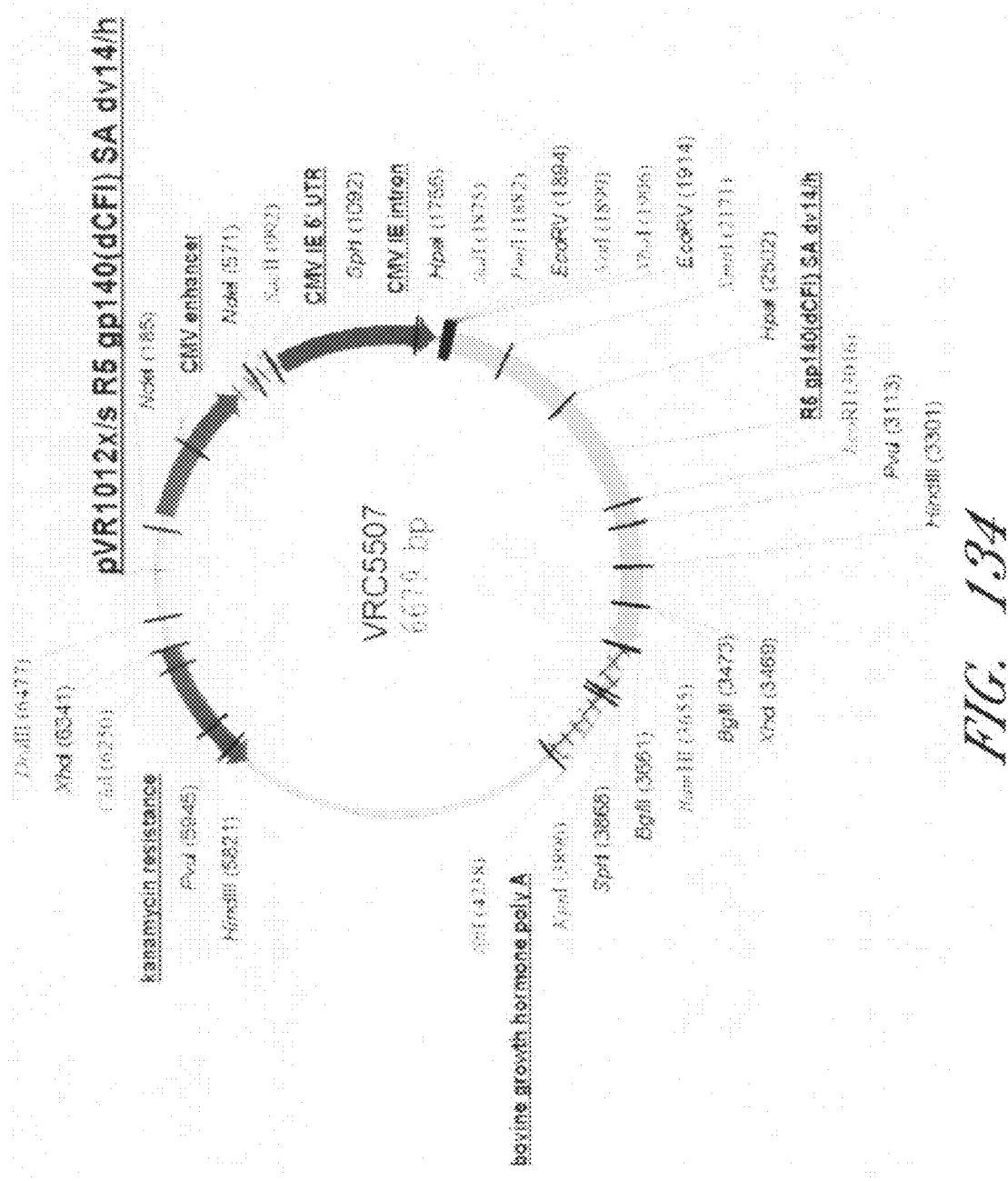
FIG. 134. Plasmid 5507.
Figure 135:
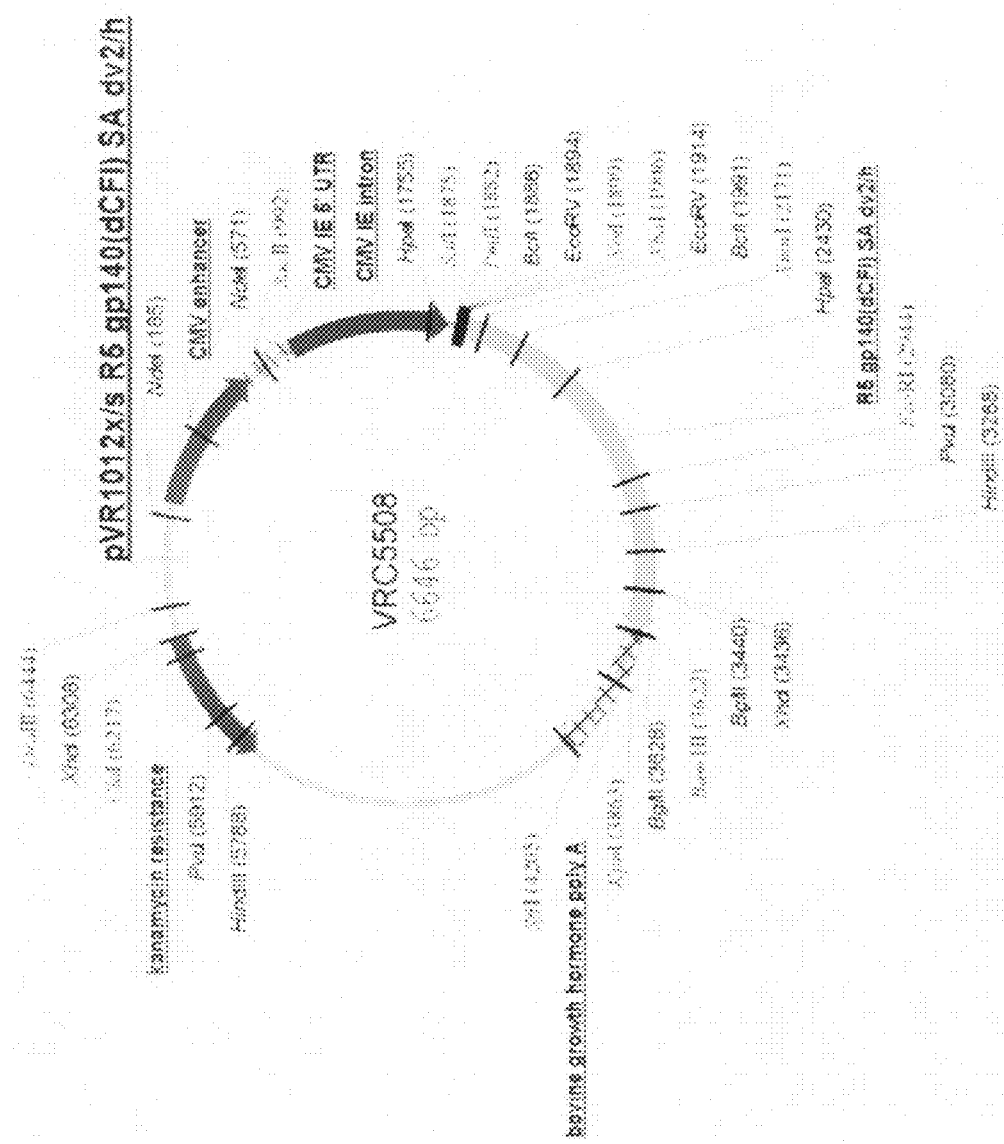
FIG. 135. Plasmid 5508.
Figure 136:
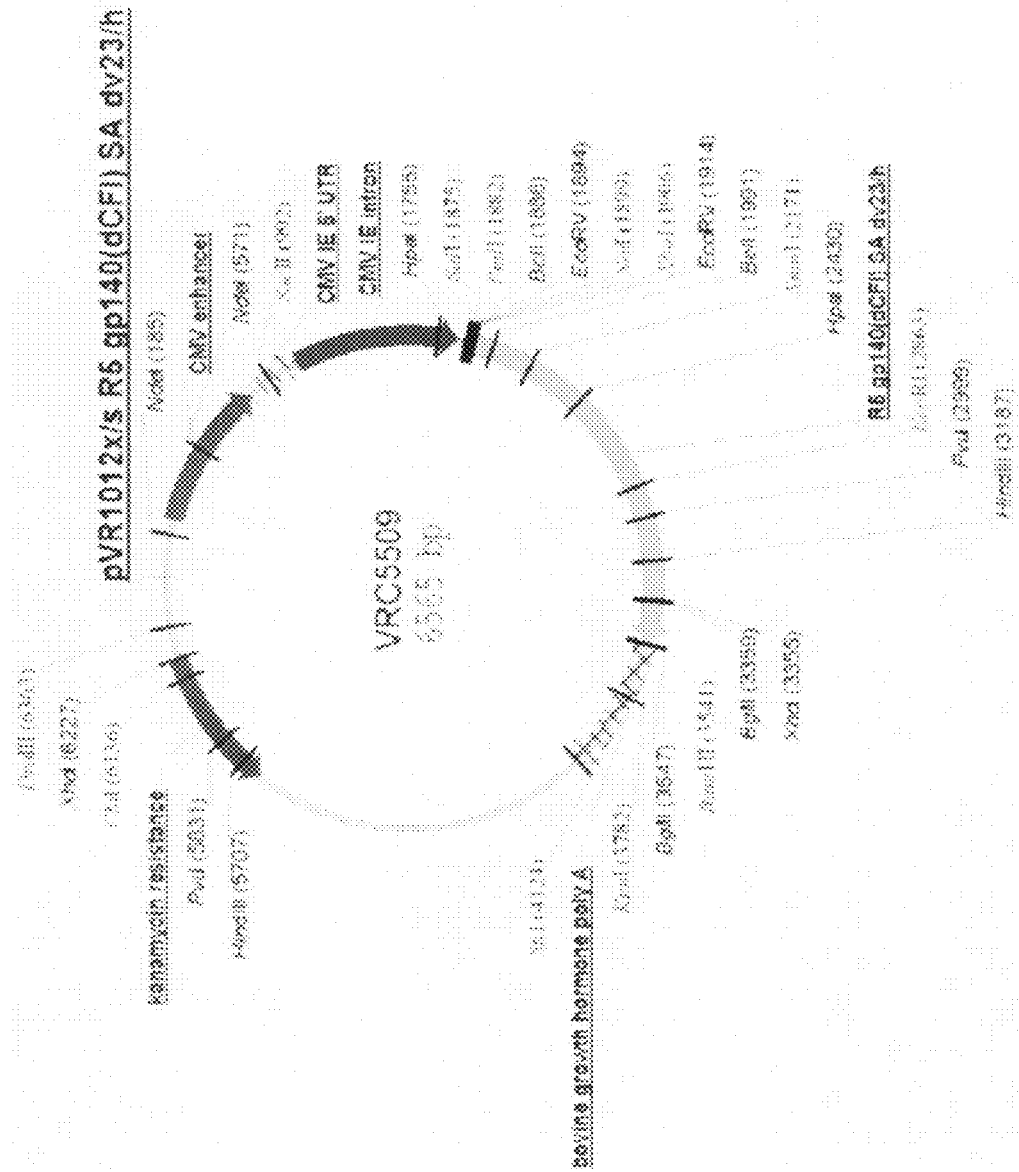
FIG. 136. Plasmid 5509.
Figure 137:
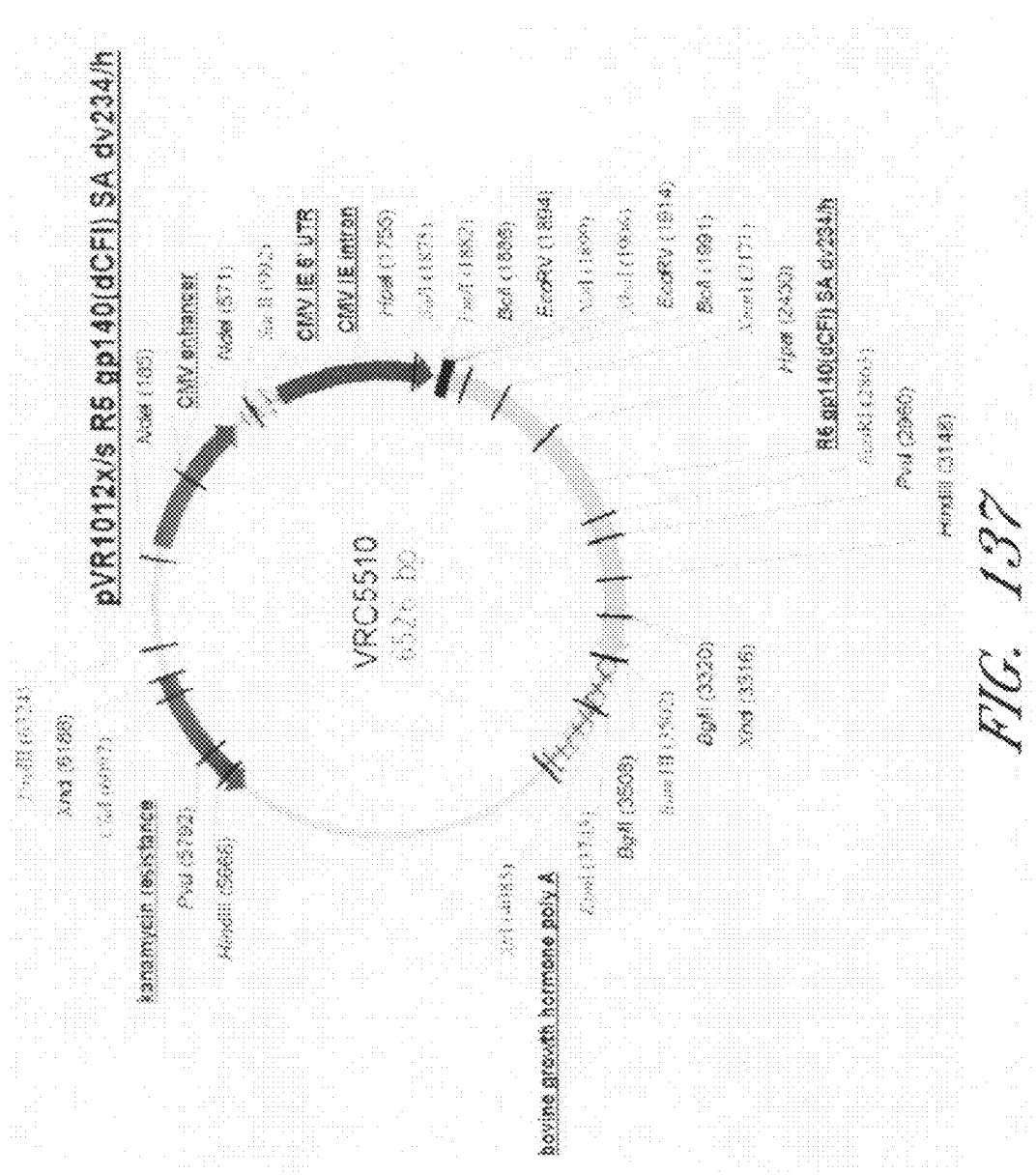
FIG. 137. Plasmid 5510.
Figure 138:
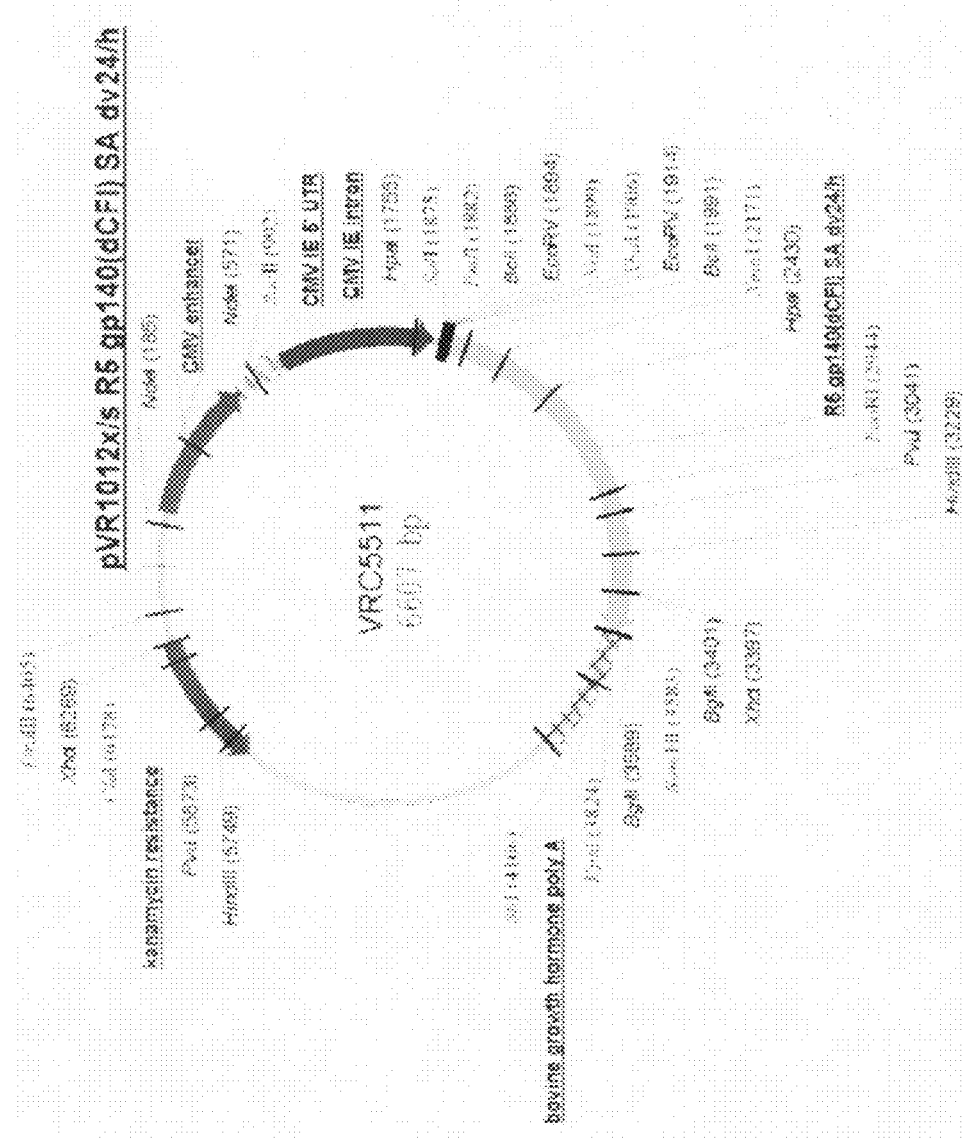
FIG. 138. Plasmid 5511.
Figure 139:
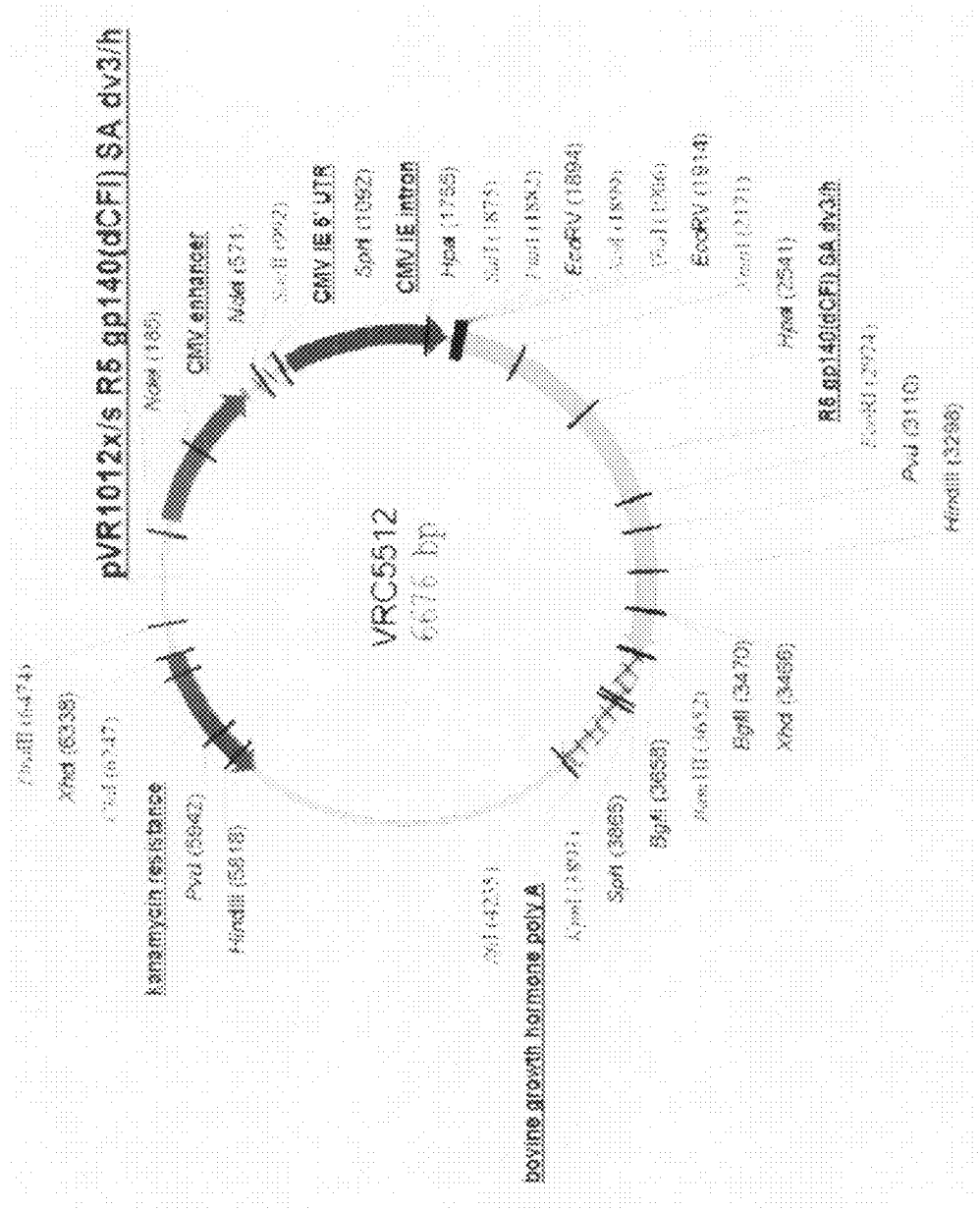
FIG. 139. Plasmid 5512.
Figure 140:
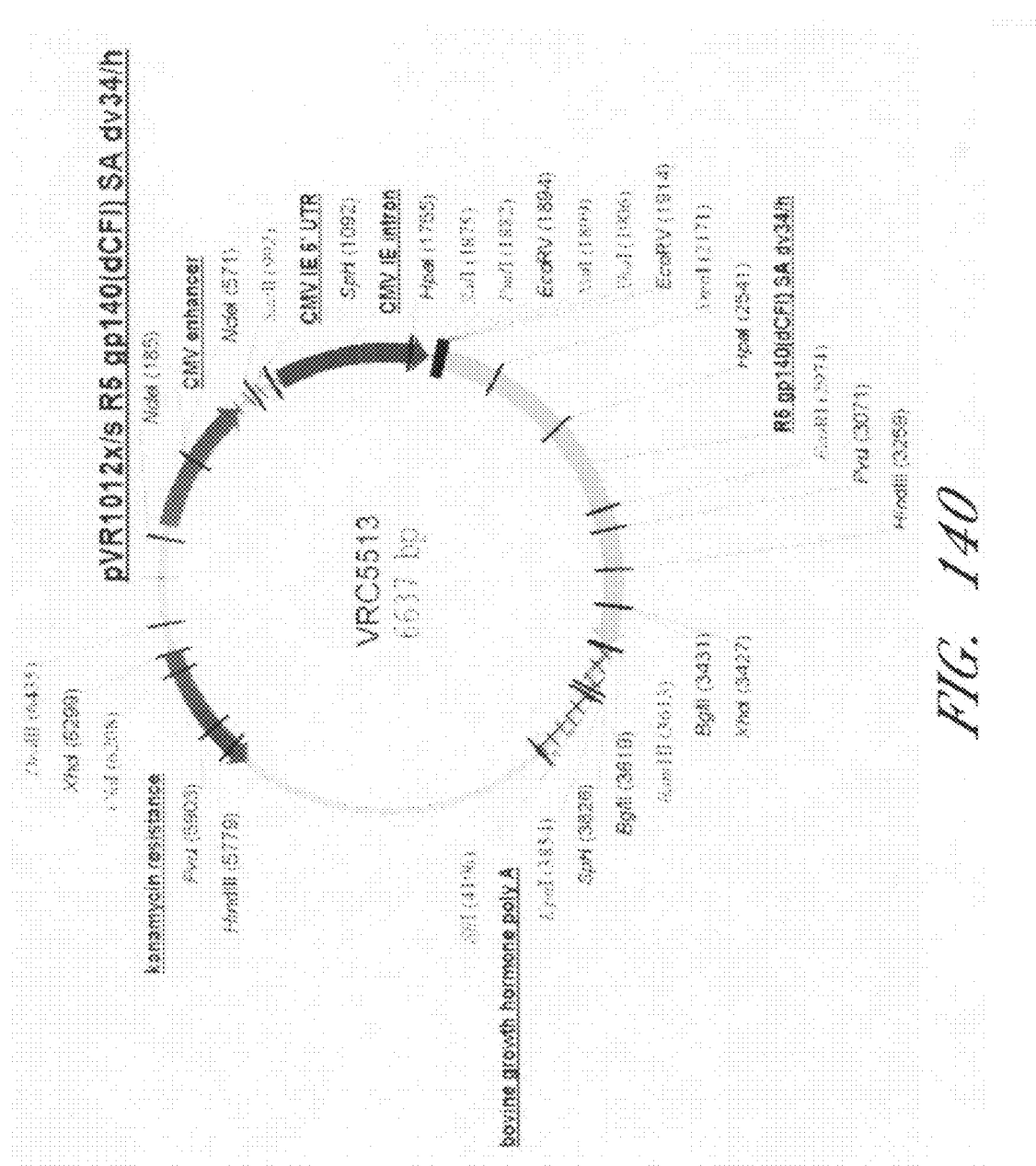
FIG. 140. Plasmid 5513.
Figure 141:
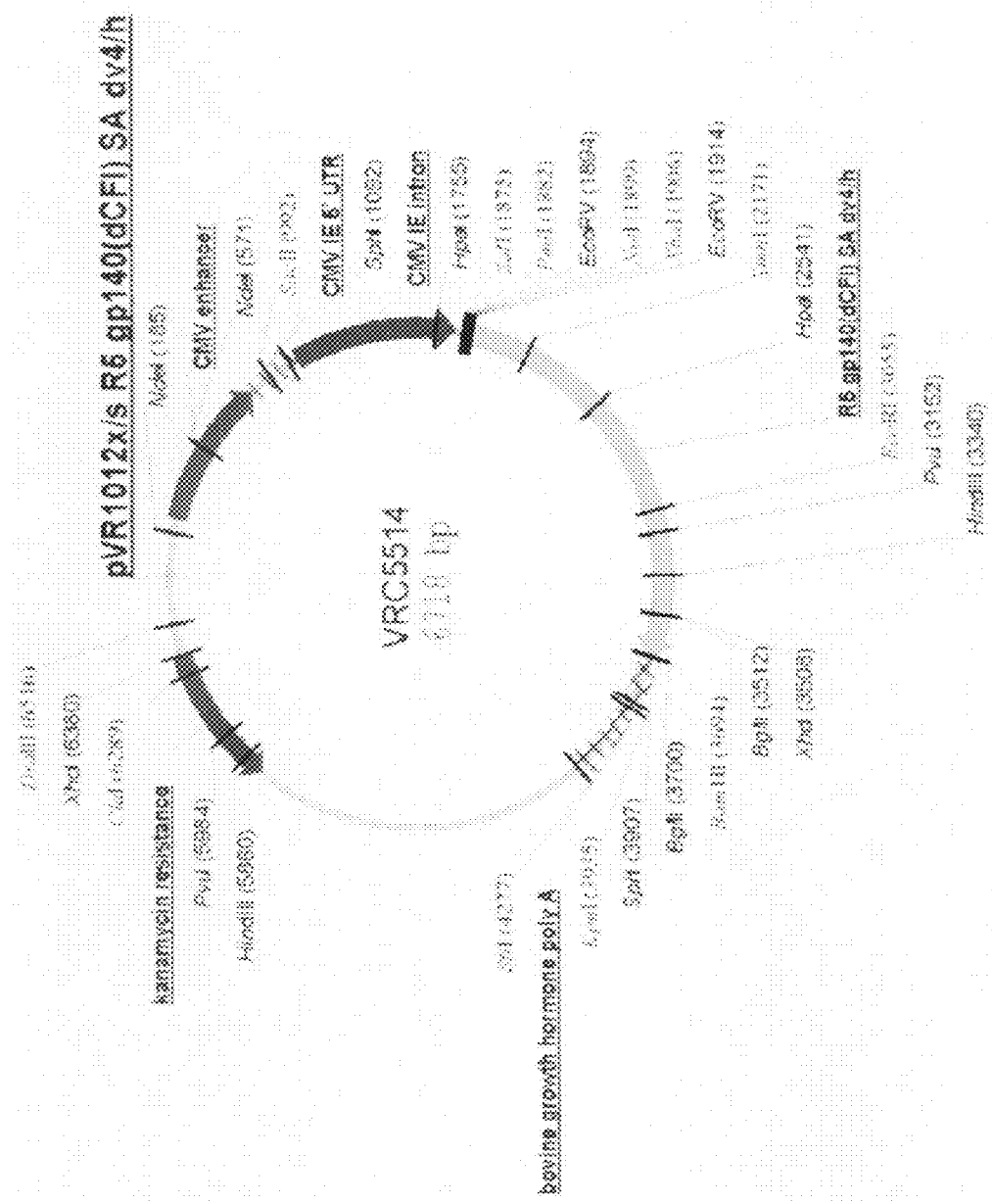
FIG. 141. Plasmid 5514.
Figure 142:
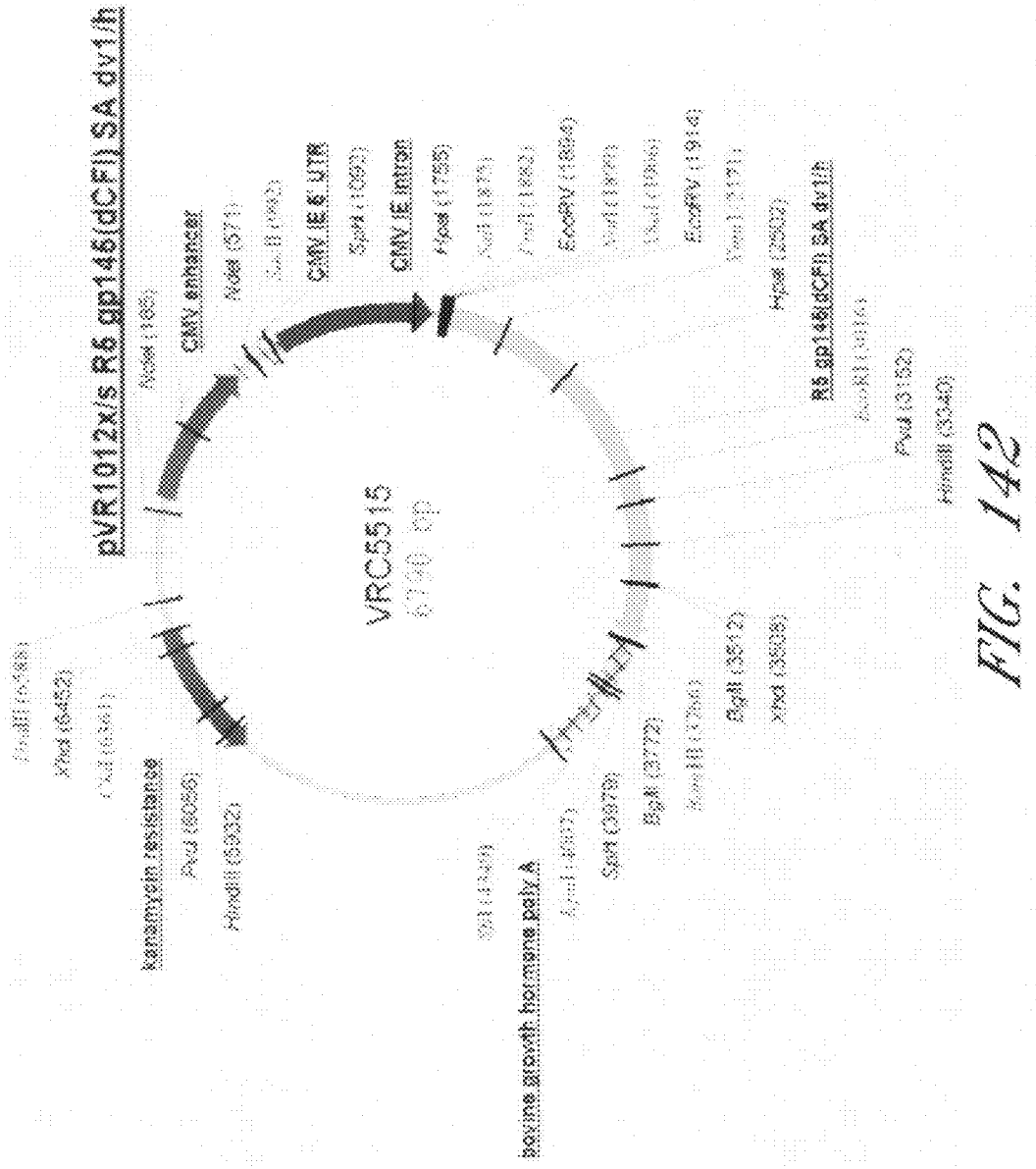
FIG. 142. Plasmid 5515.
Figure 143:
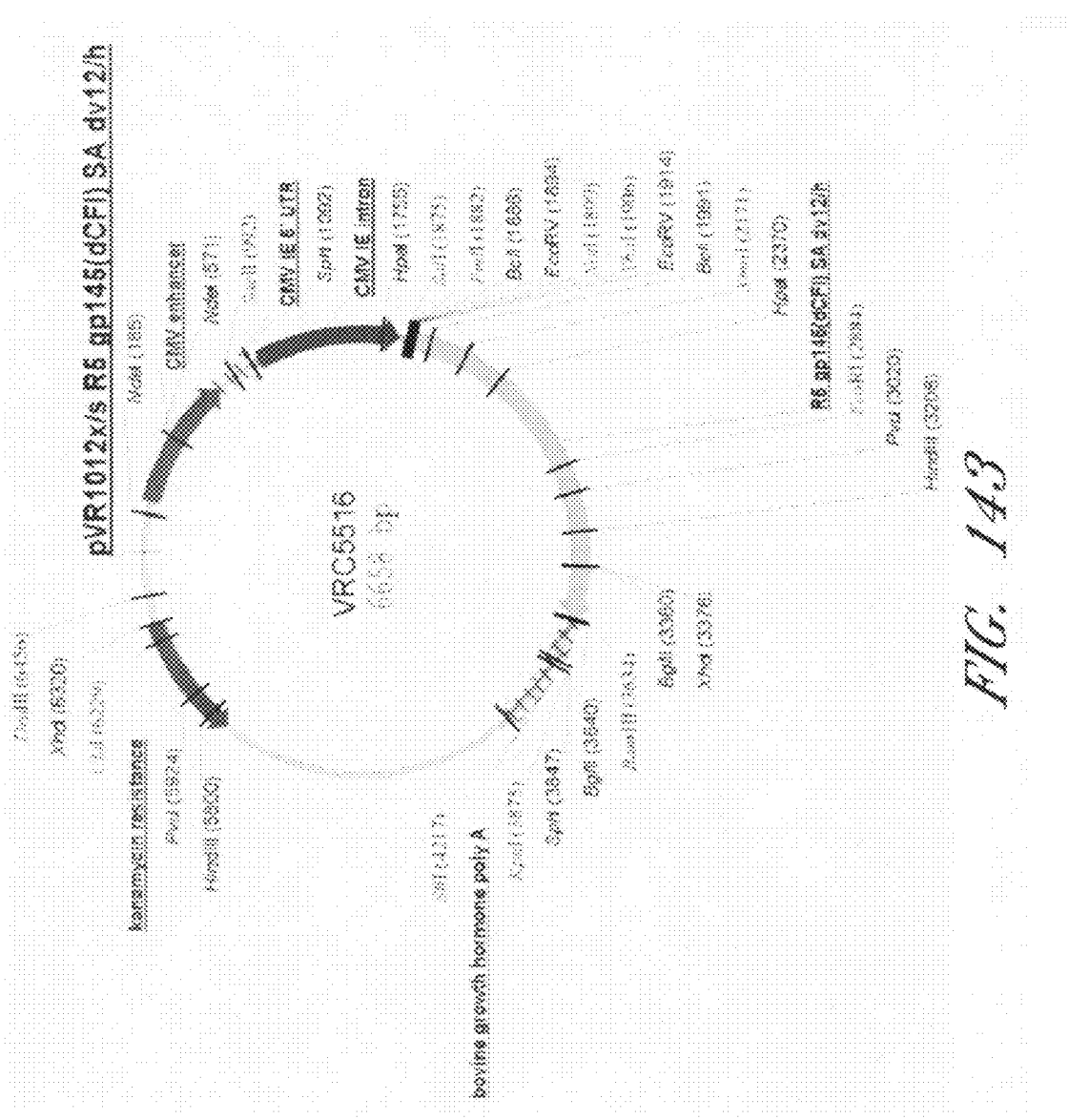
FIG. 143. Plasmid 5516.
Figure 144:
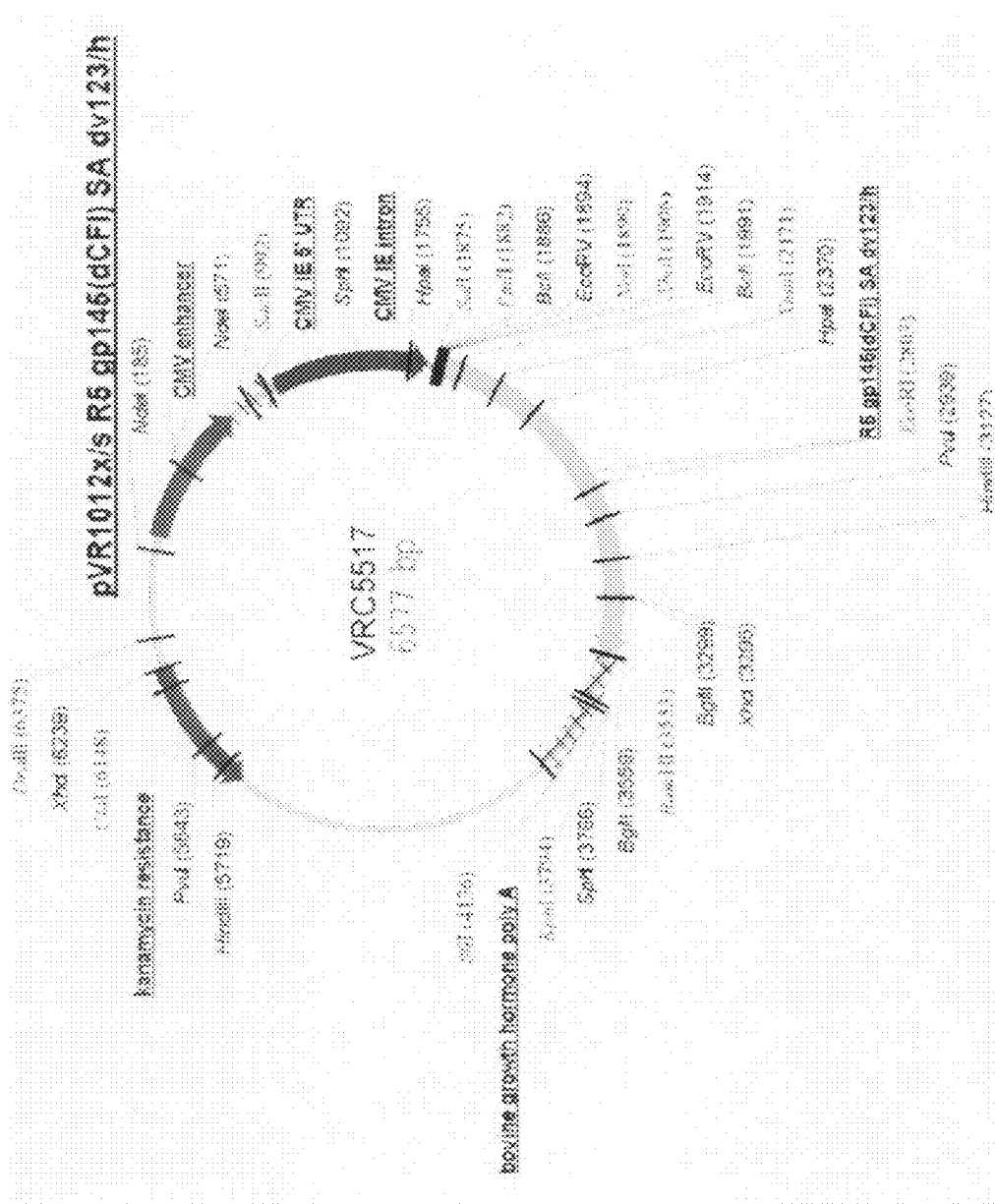
FIG. 144. Plasmid 5517.
Figure 145:
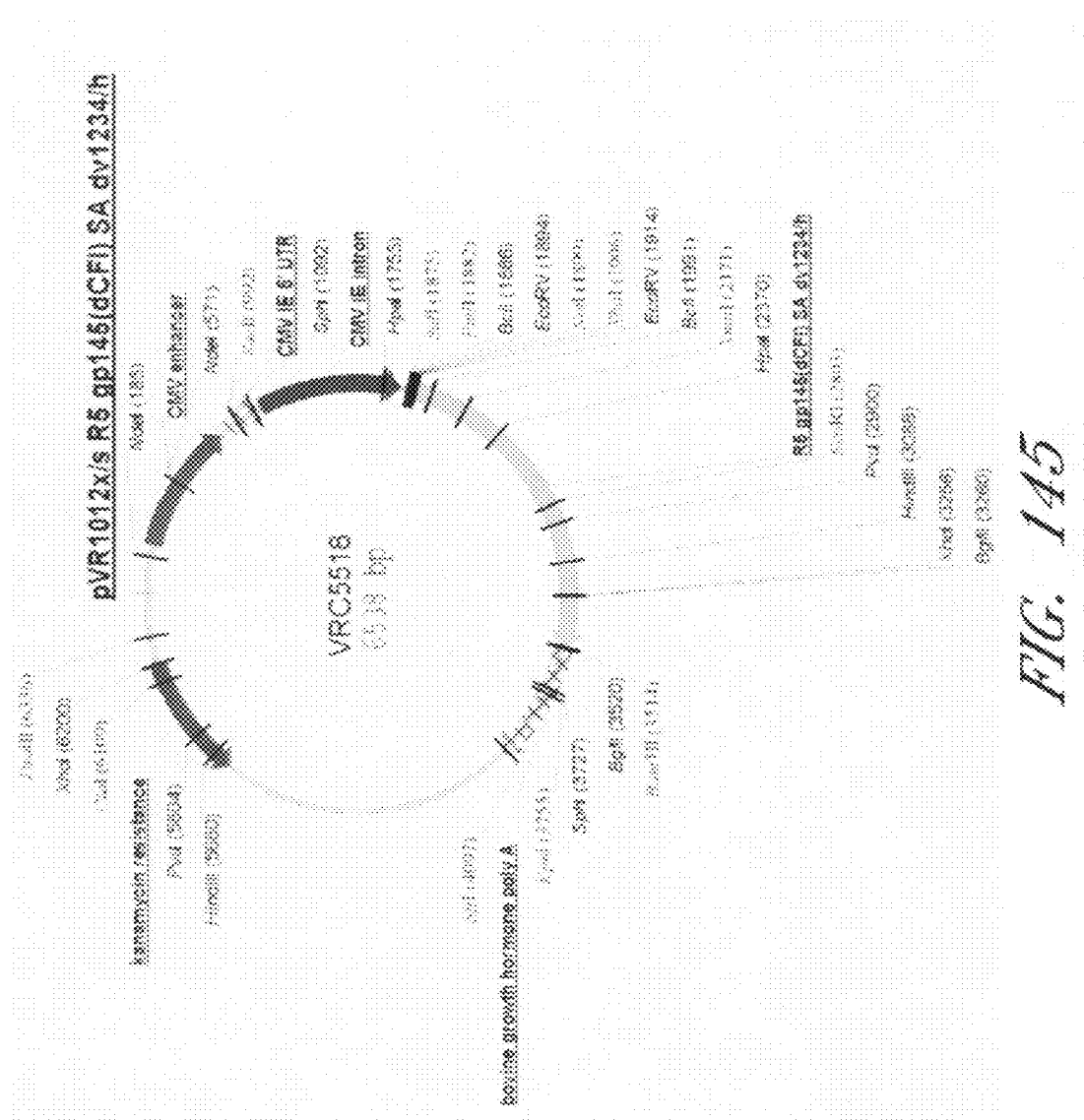
FIG. 145. Plasmid 5518.
Figure 146:
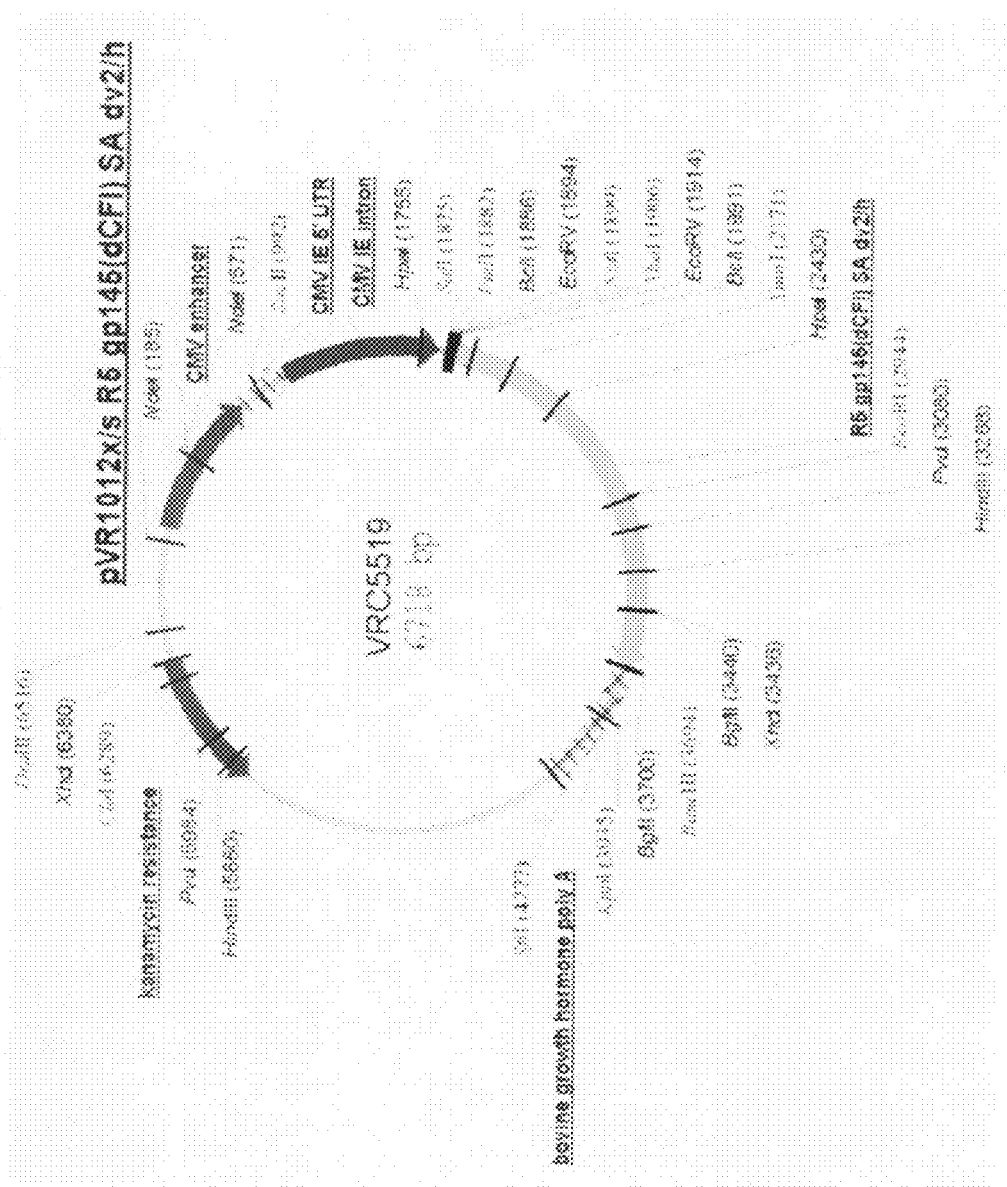
FIG. 146. Plasmid 5519.
Figure 147:
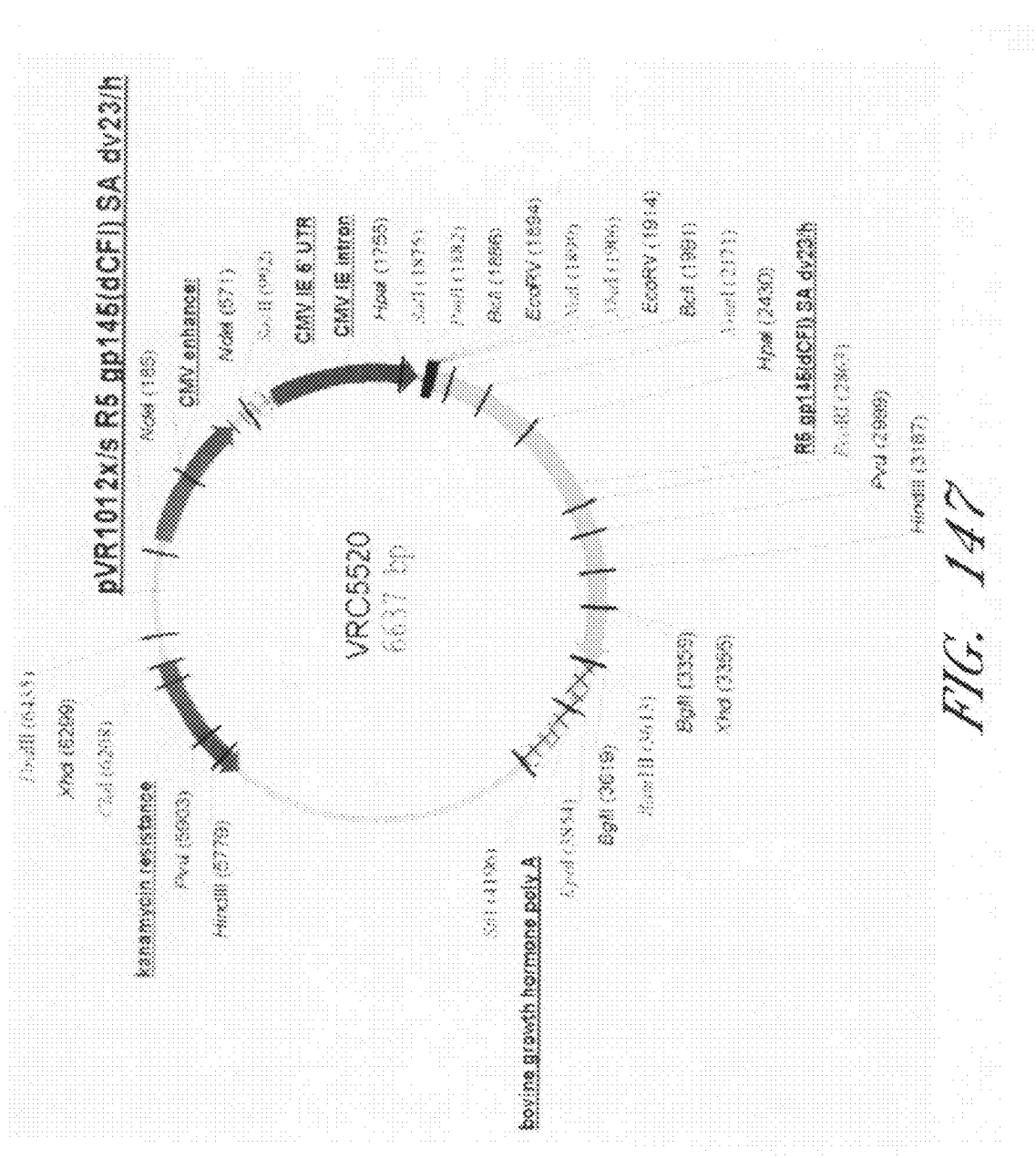
FIG. 147. Plasmid 5520.
Figure 148:
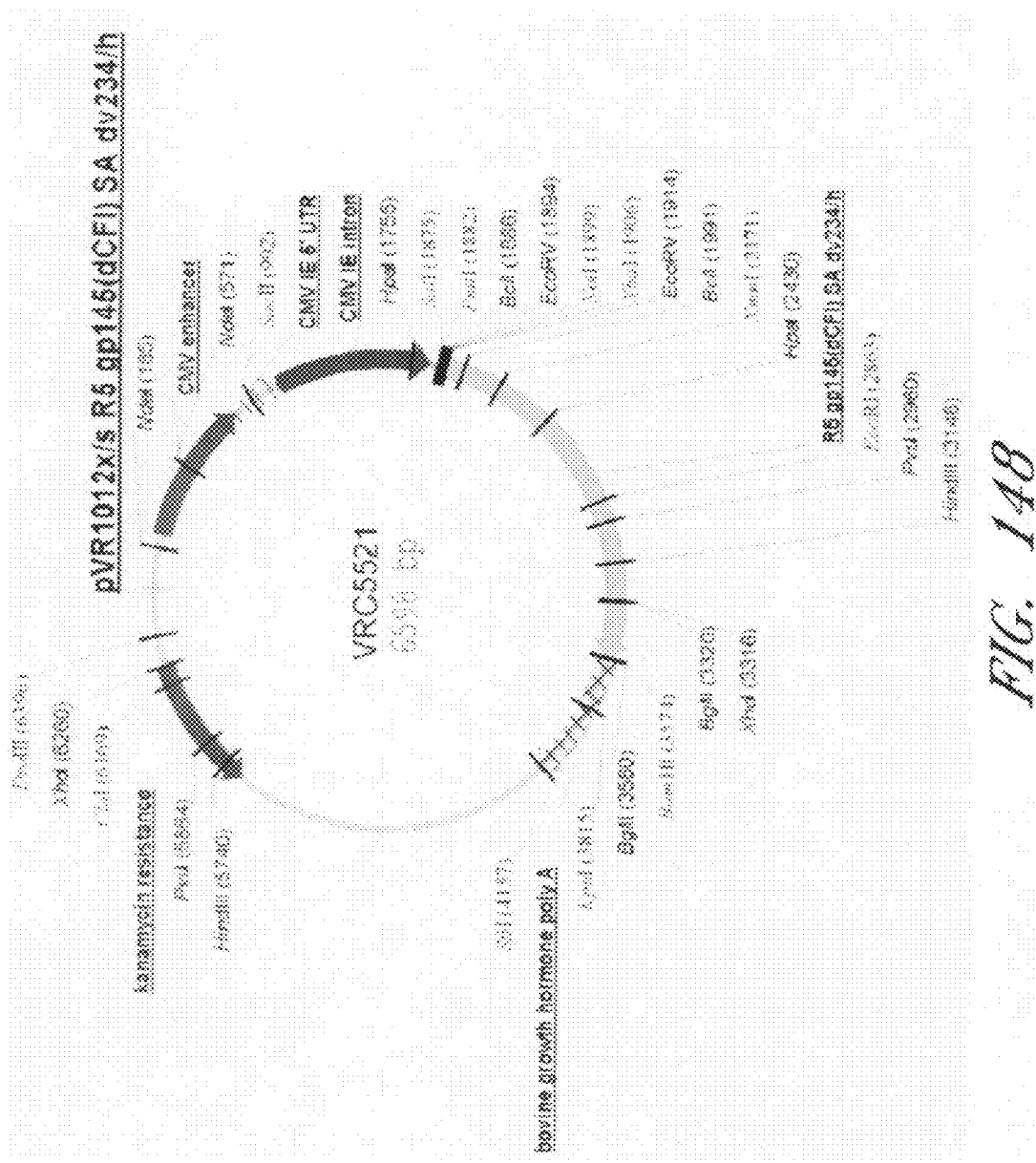
FIG. 148. Plasmid 5521.
Figure 149:
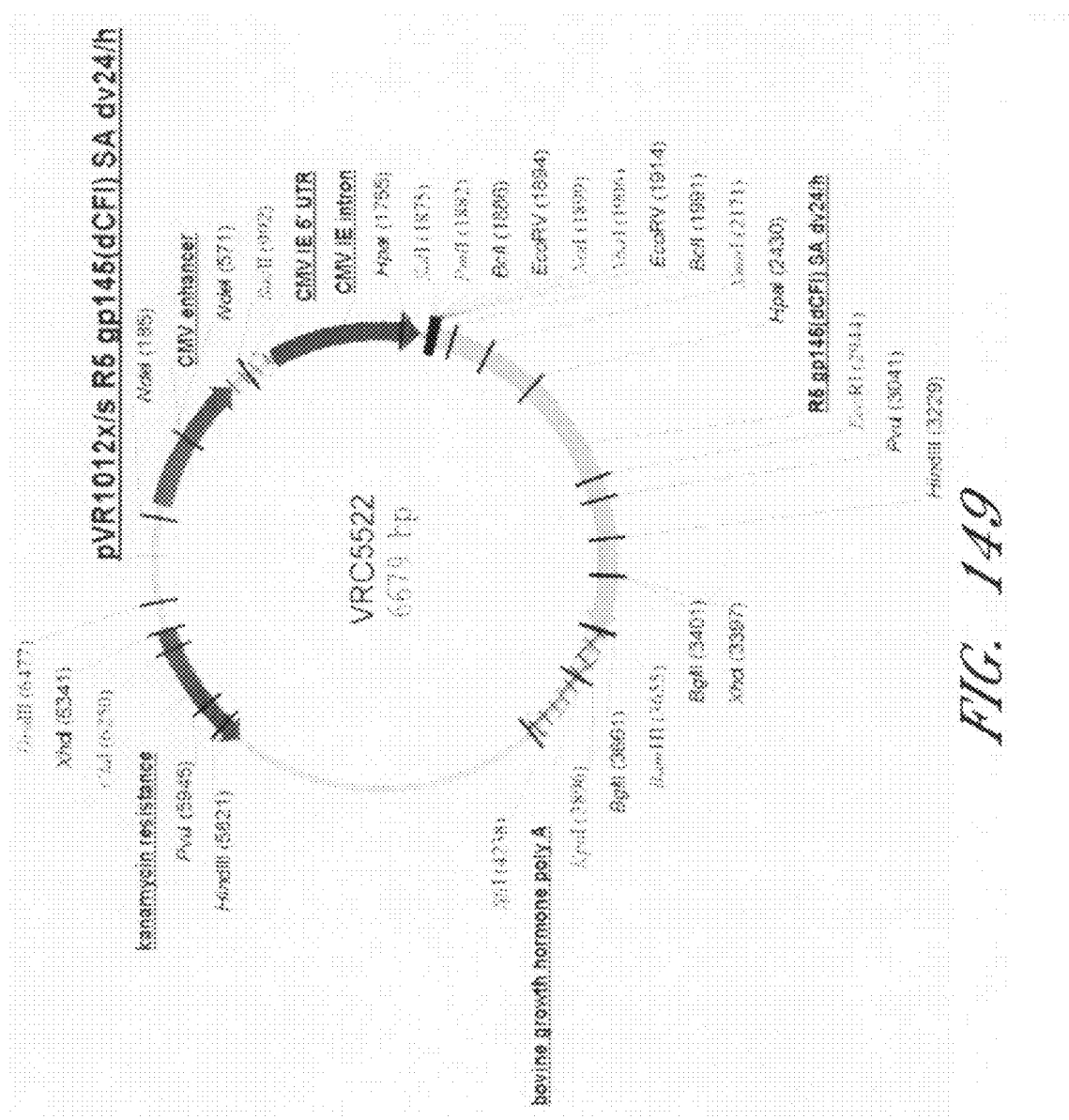
FIG. 149. Plasmid 5522.
Figure 150:
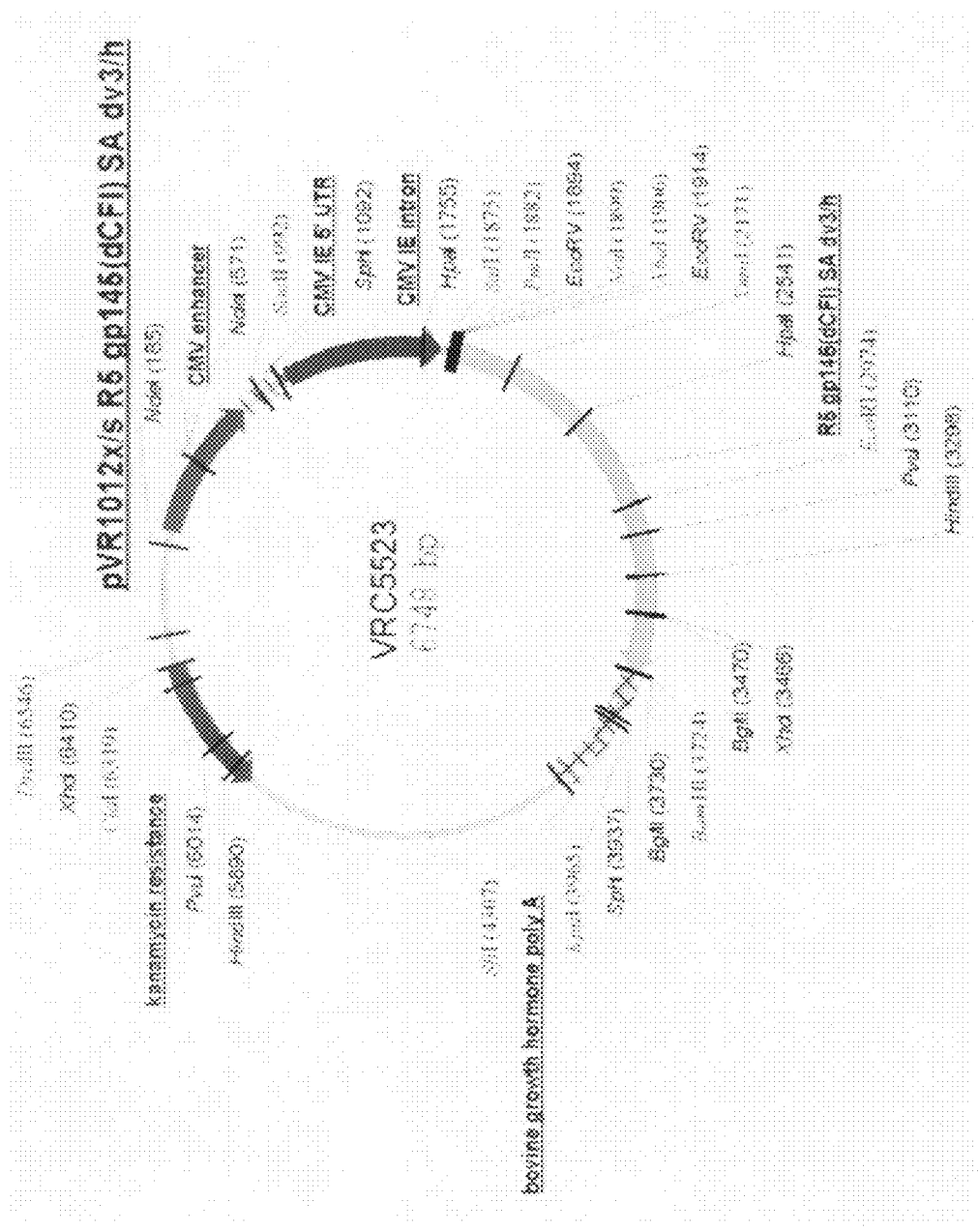
FIG. 150. Plasmid 5523.
Figure 151:
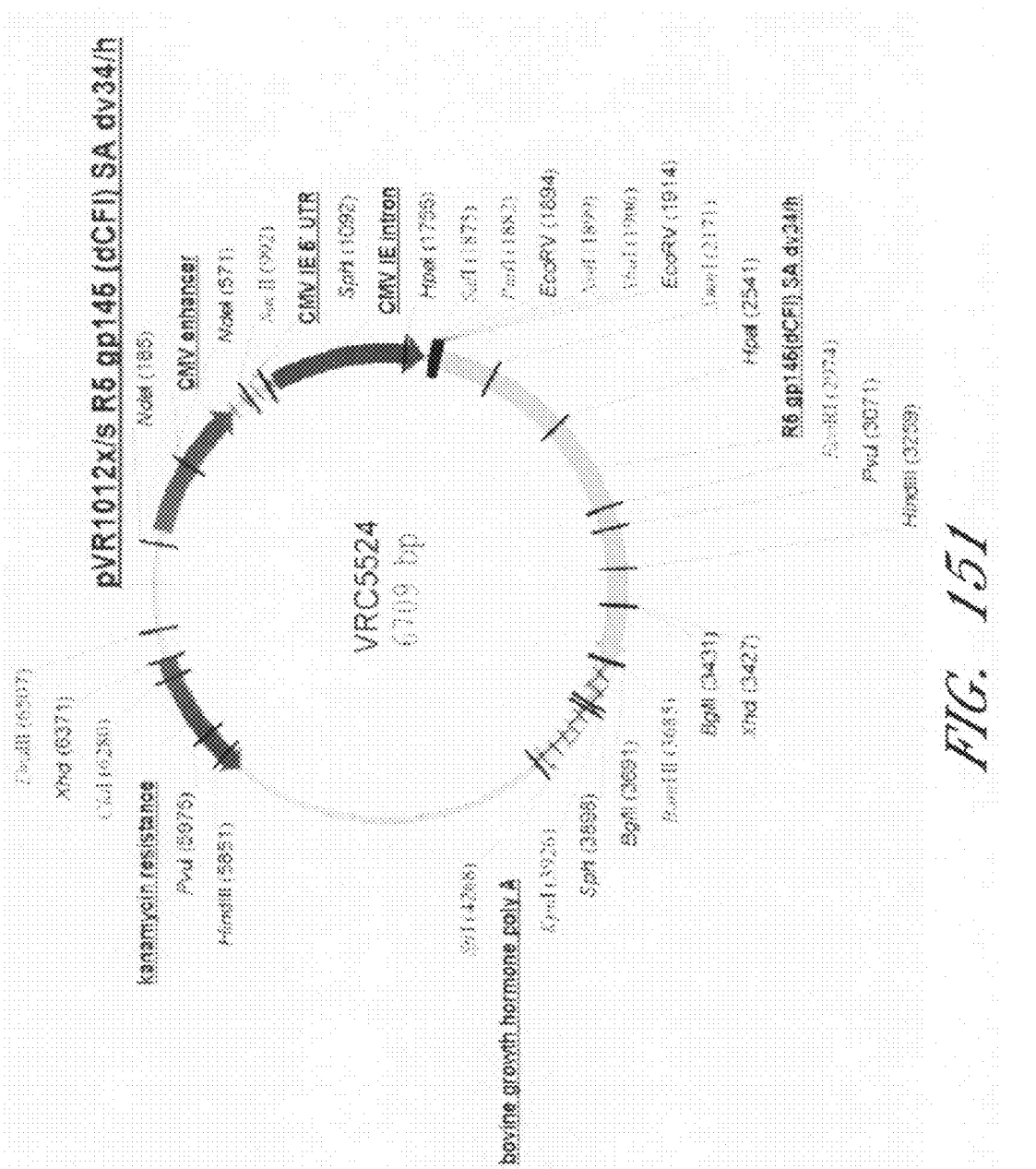
FIG. 151. Plasmid 5524.
Figure 152:
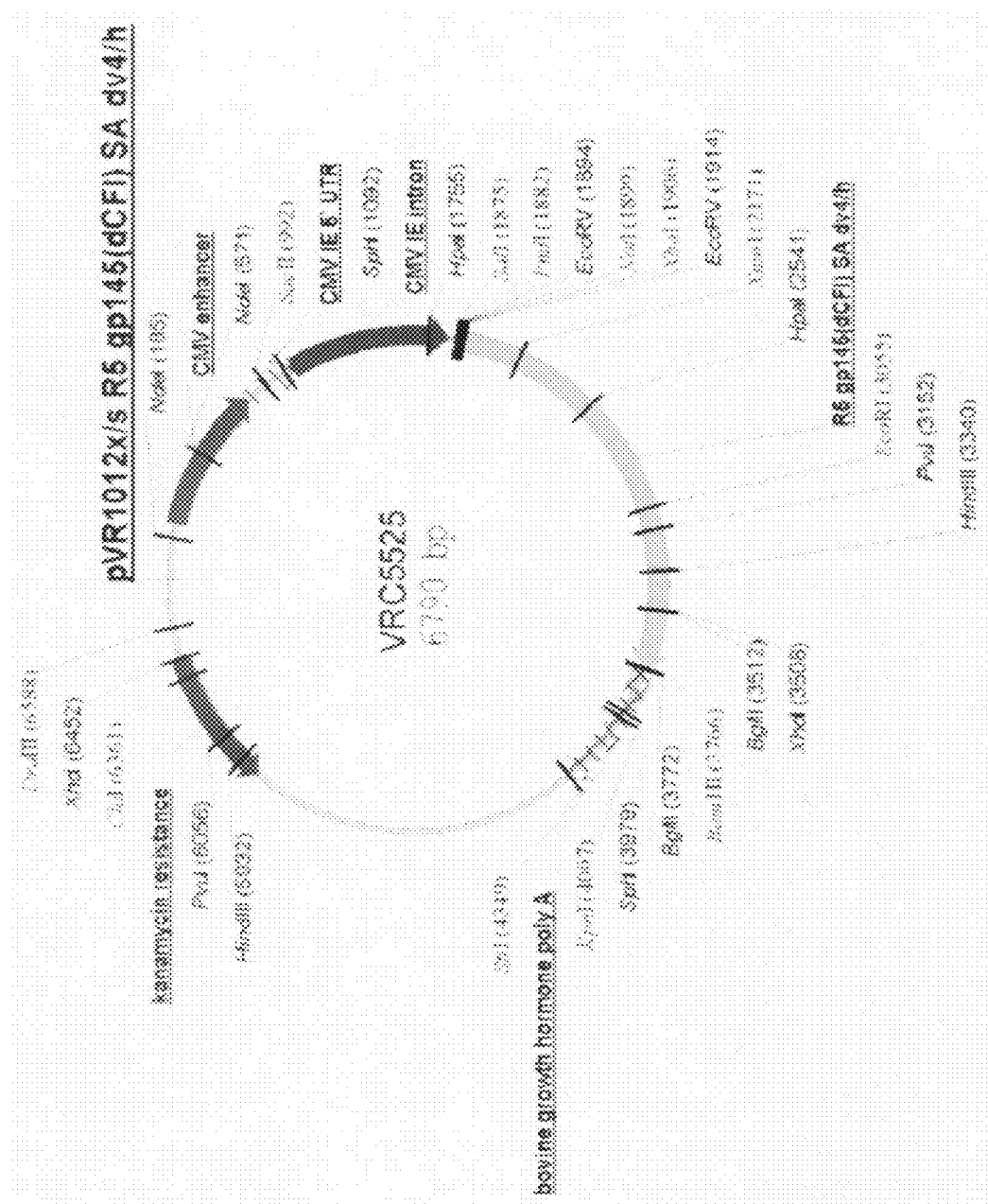
FIG. 152. Plasmid 5525.
Figure 153:
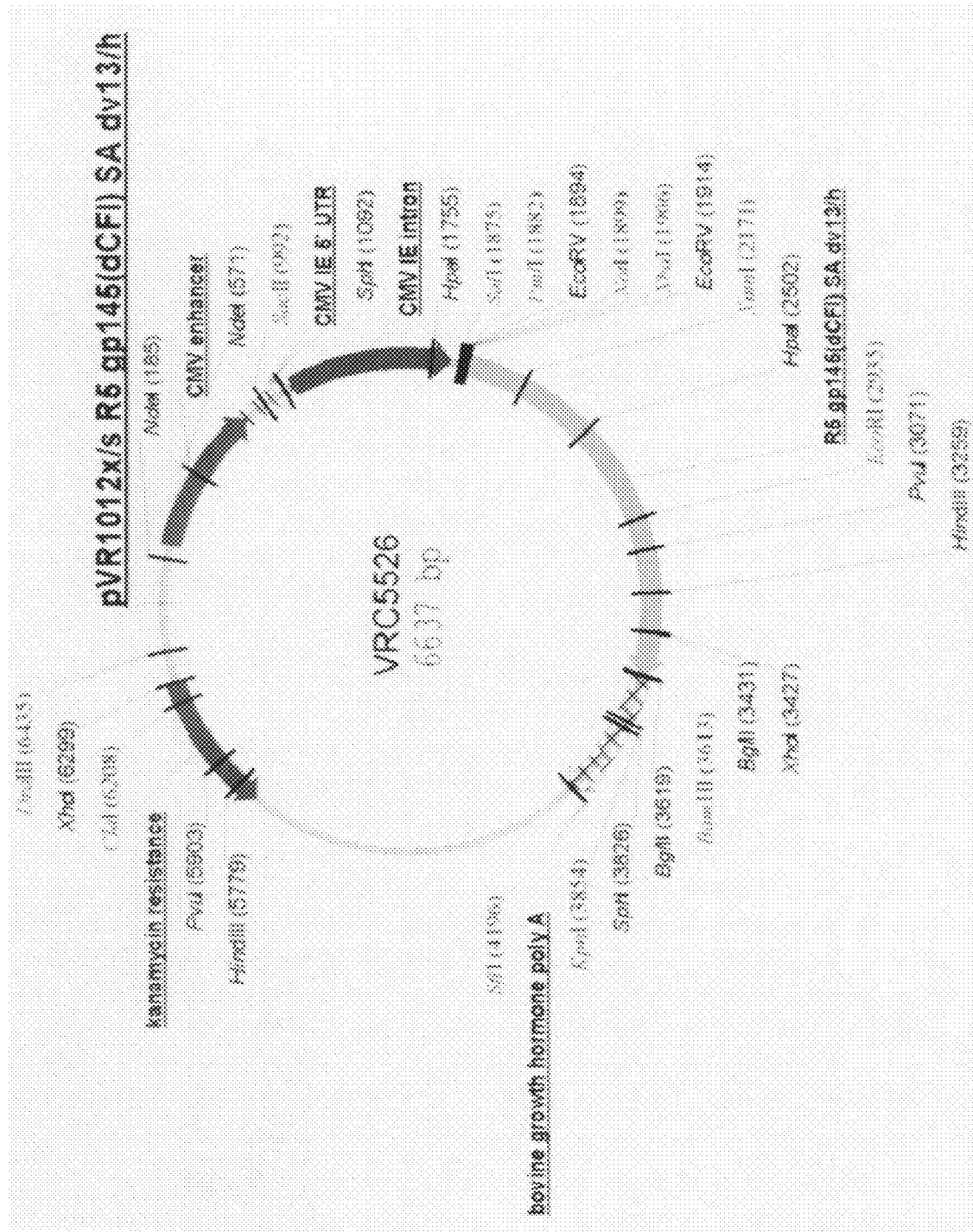
FIG. 153. Plasmid 5526.
Figure 154:
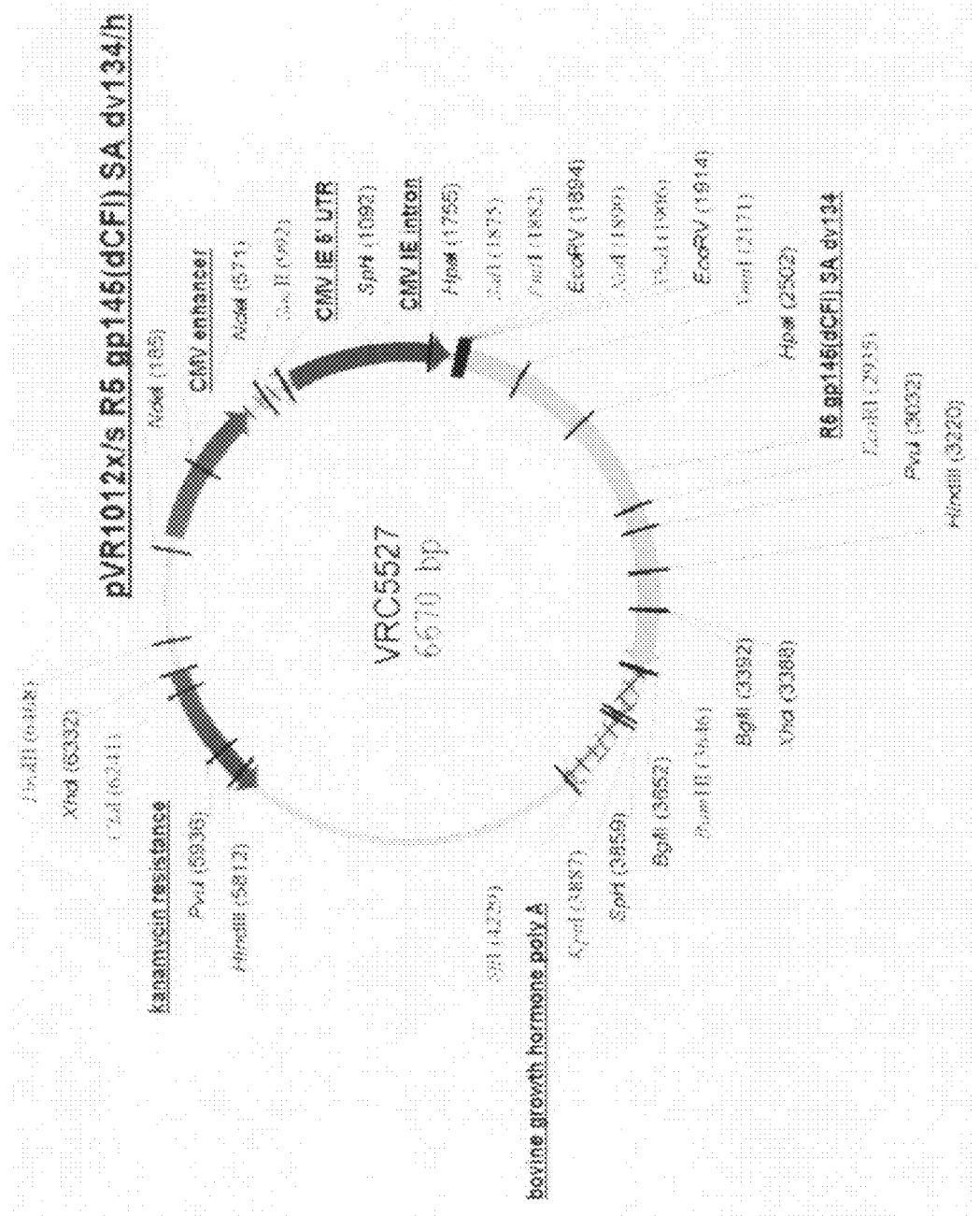
FIG. 154. Plasmid 5527.
Figure 155:
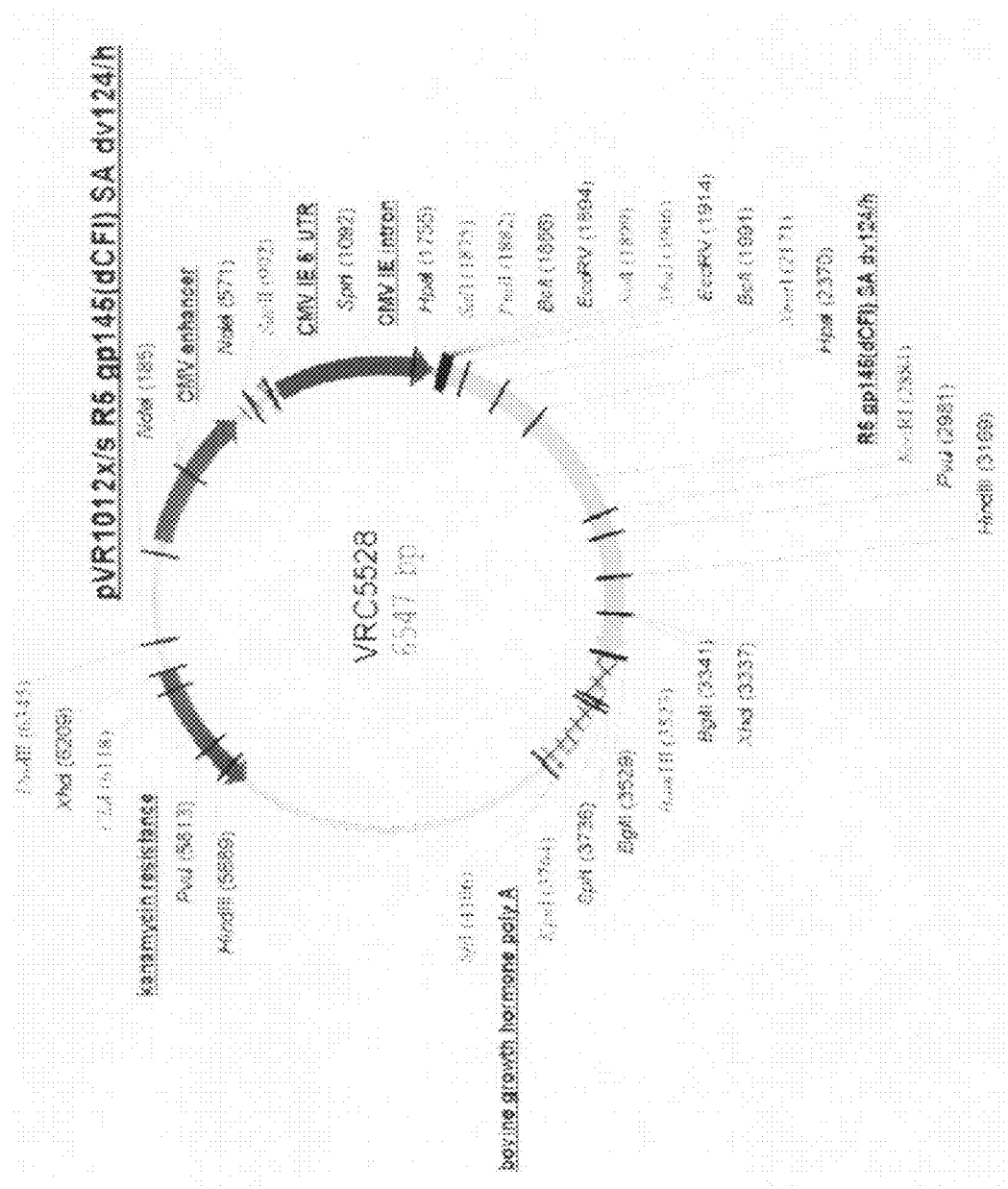
FIG. 155. Plasmid 5528.
Figure 156:
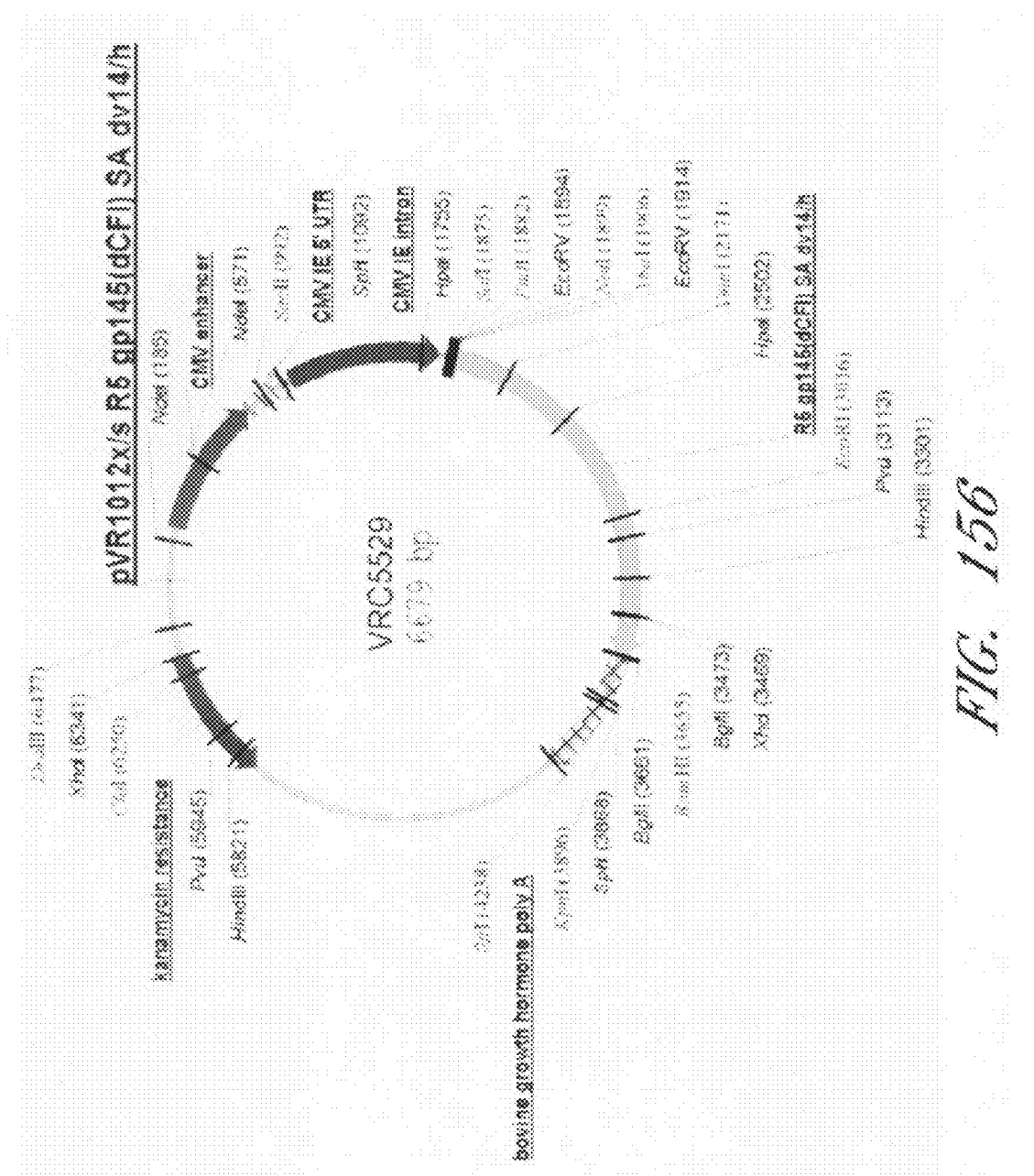
FIG. 156. Plasmid 5529.
Figure 157:
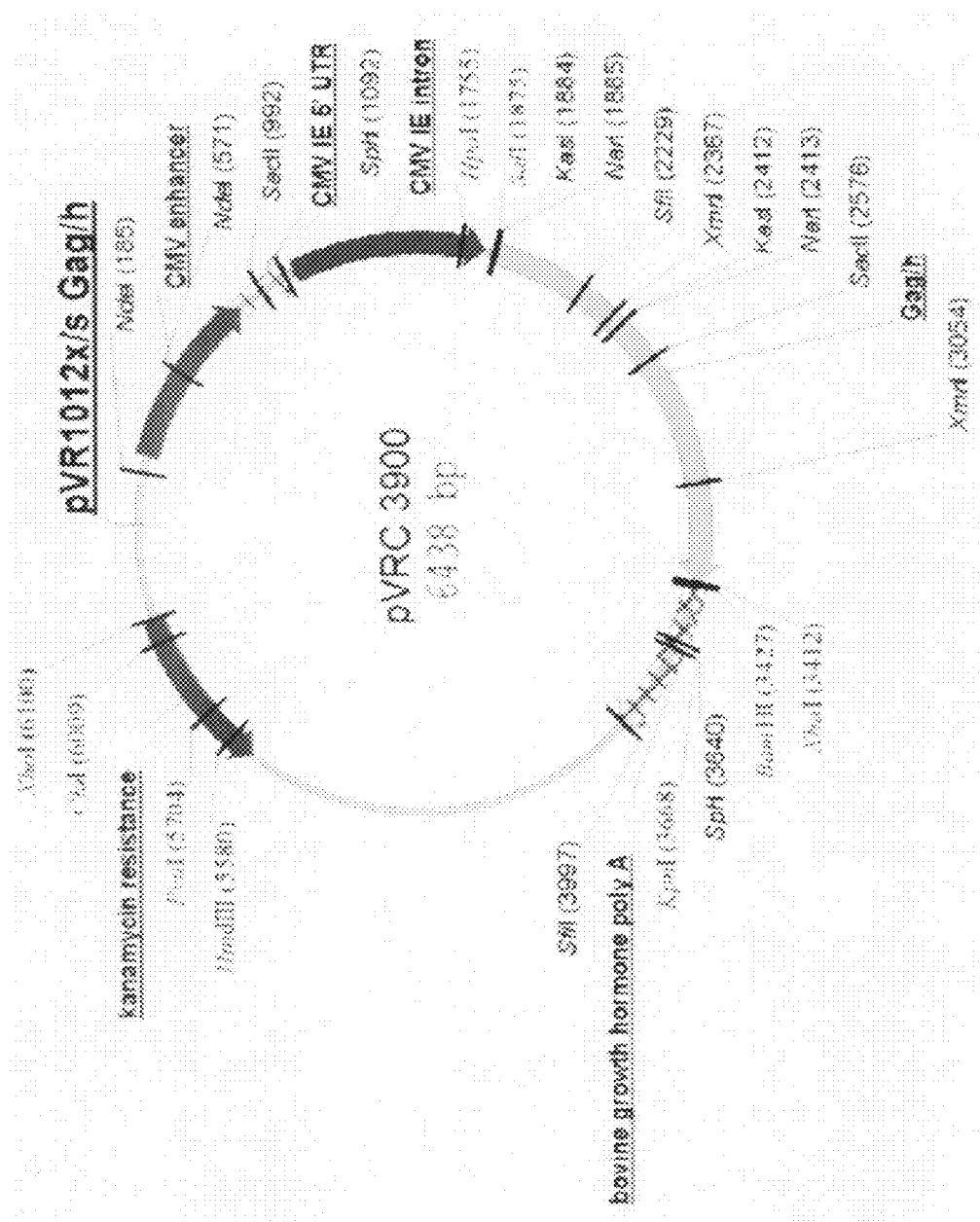
FIG. 157. Plasmid 3900.
Figure 15B:
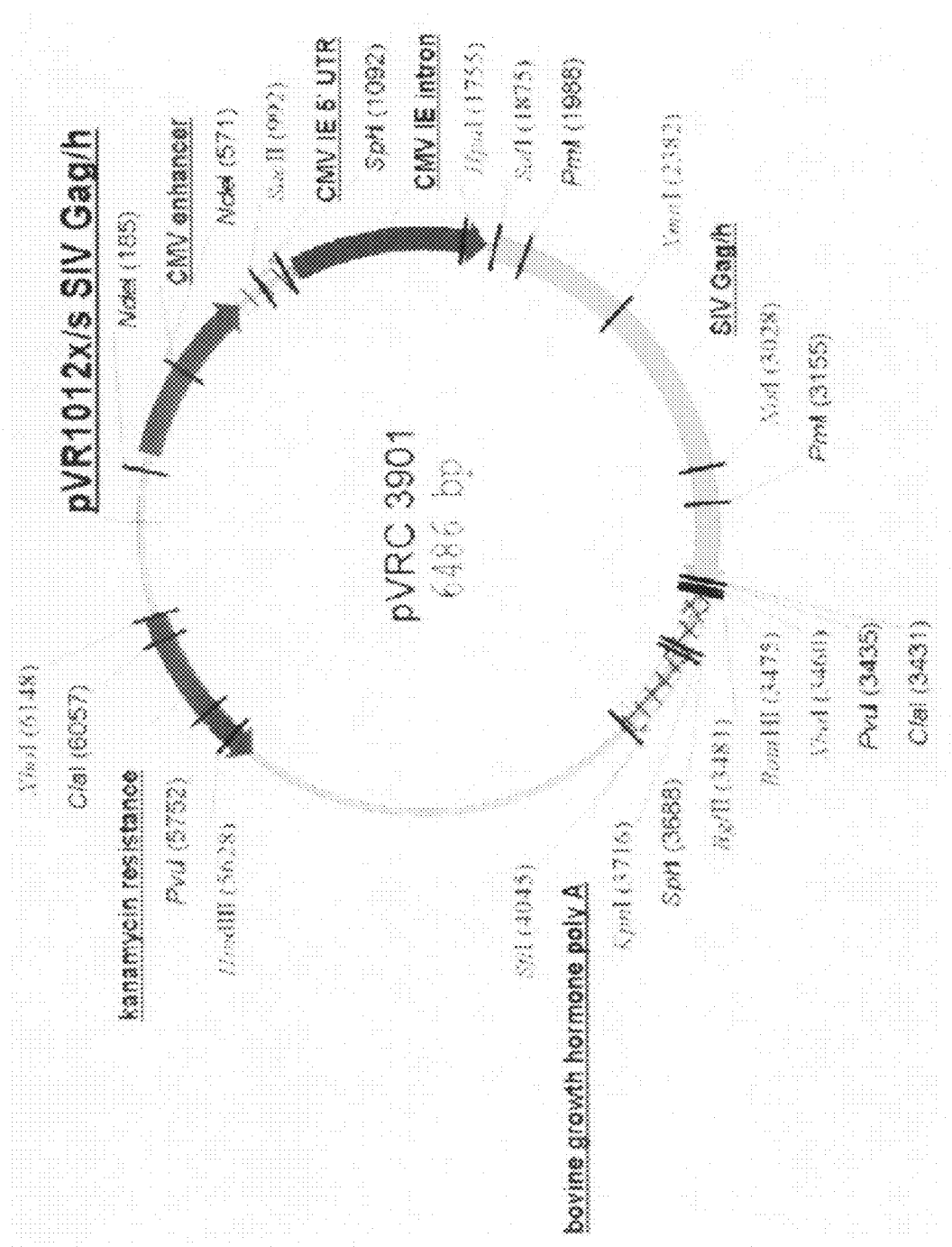
Figure 159:
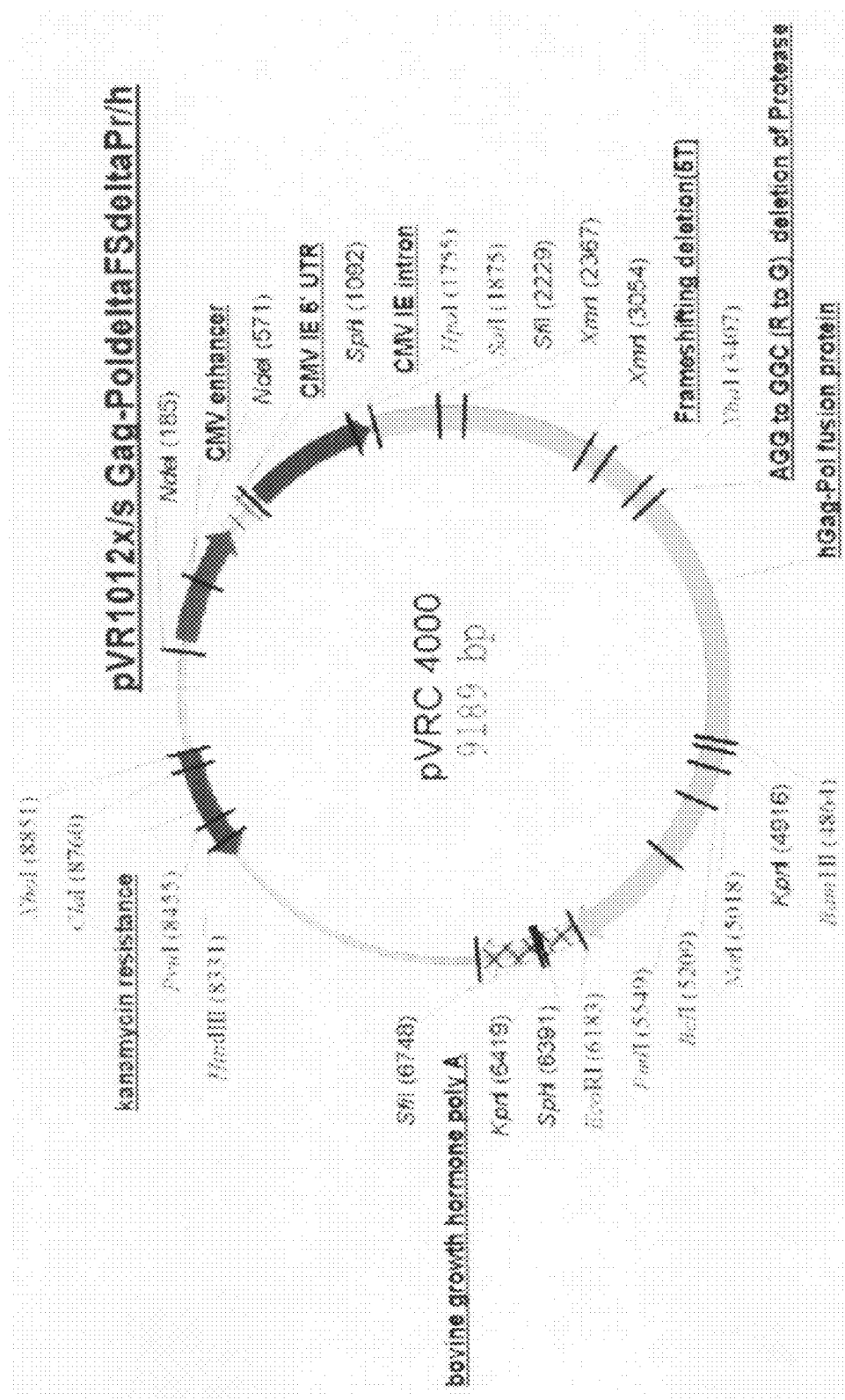
FIG. 159. Plasmid 4000.
Figure 160:
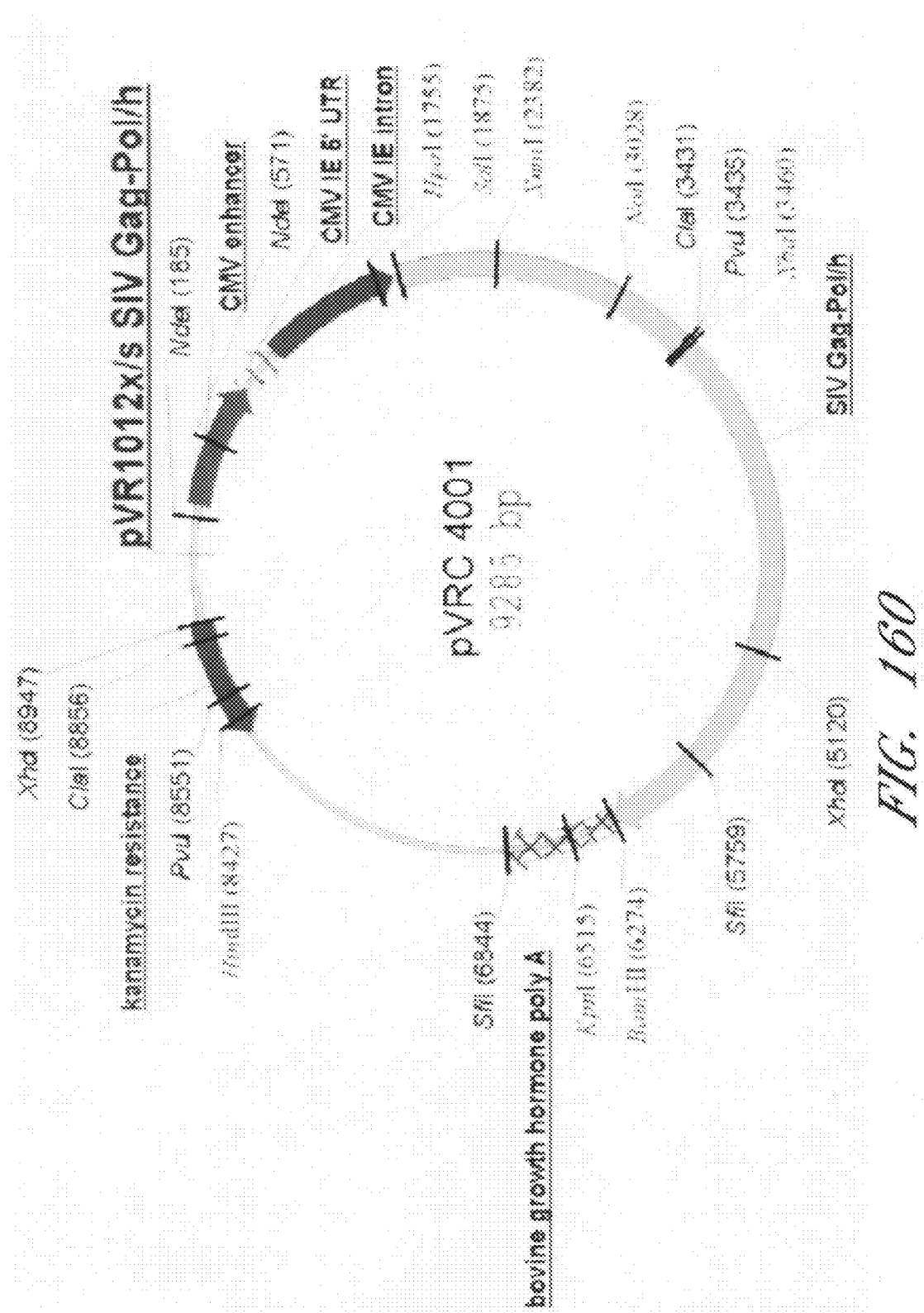
FIG. 160. Plasmid 4001.
Figure 161:
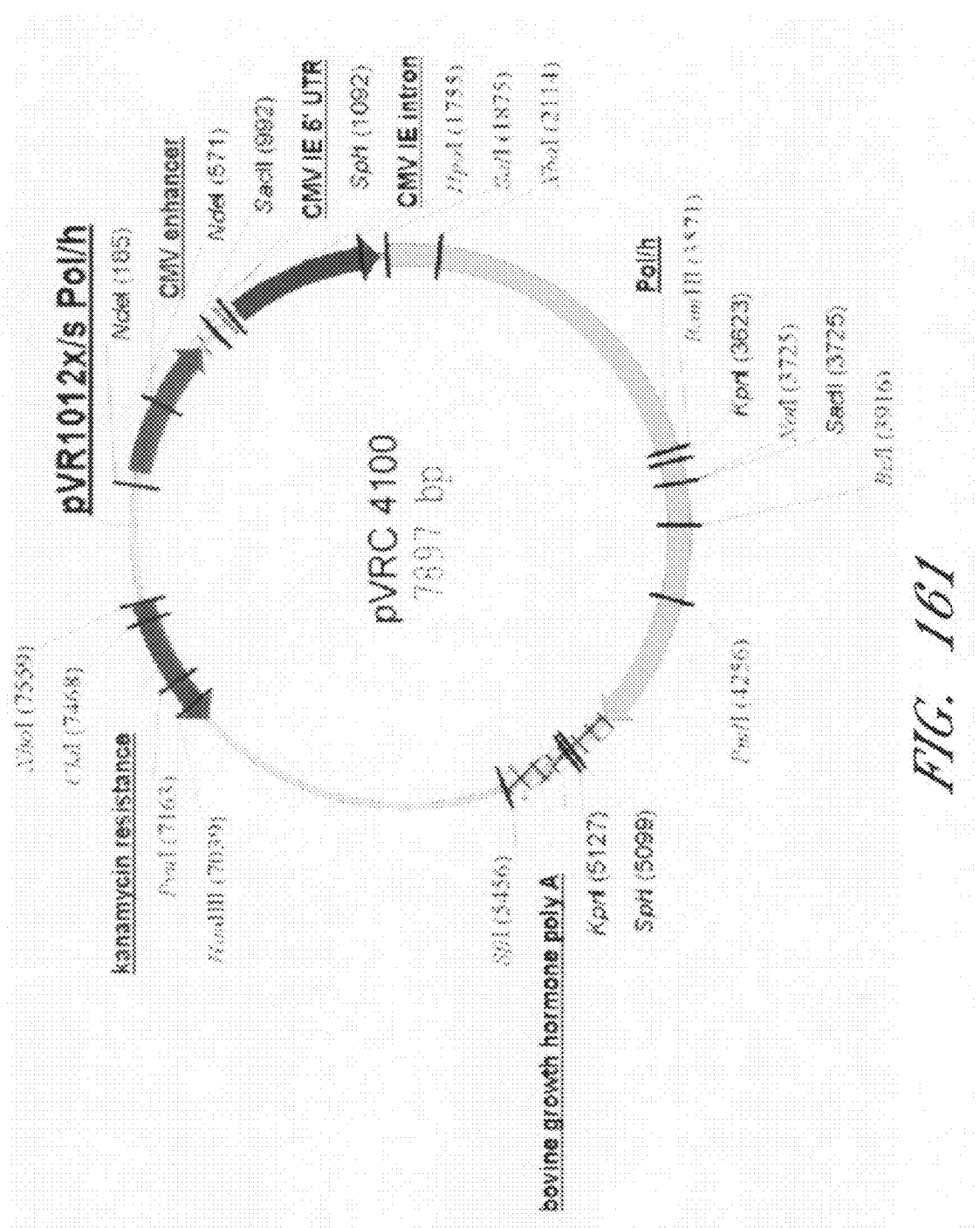
FIG. 161. Plasmid 4100.
Figure 162:
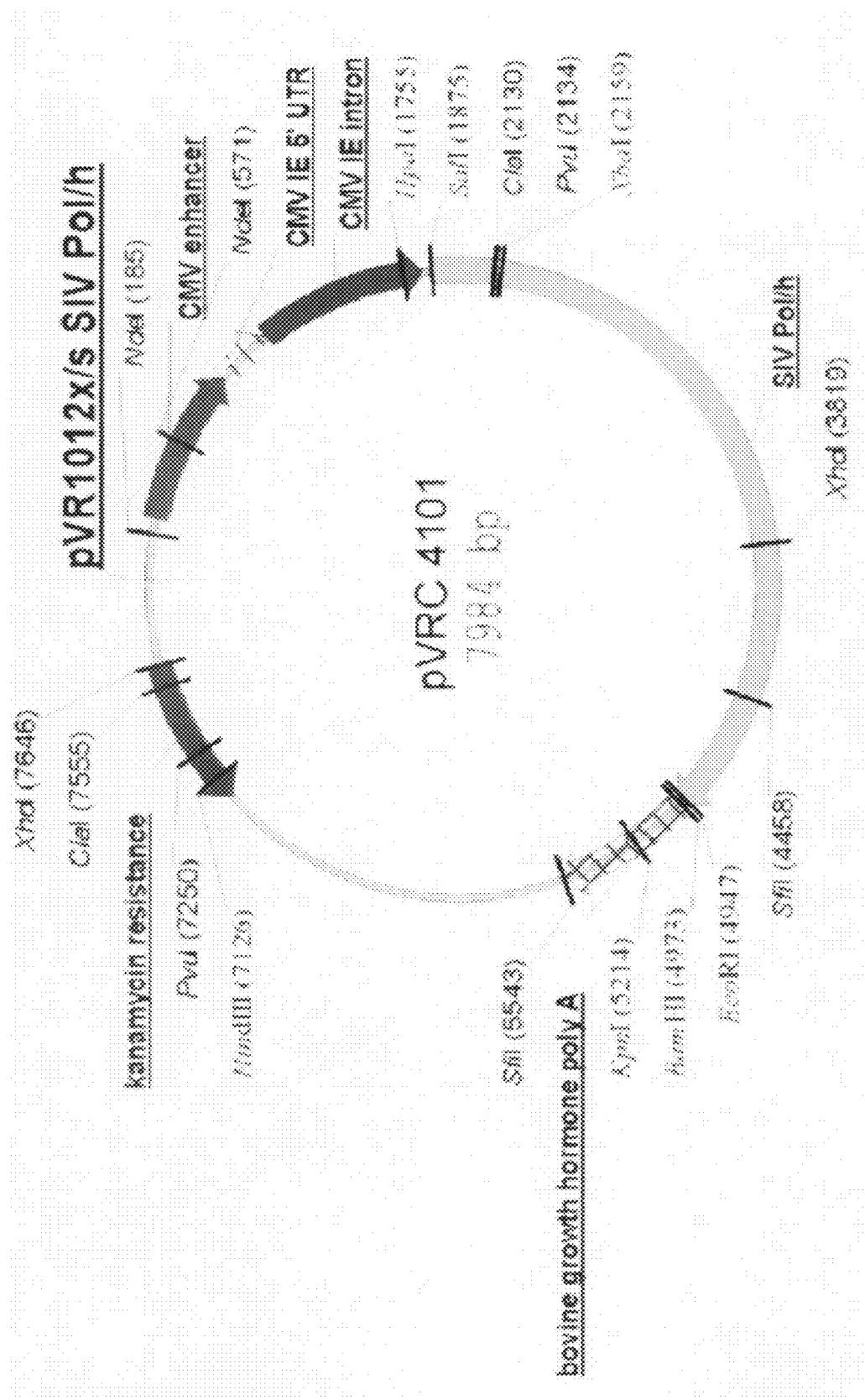
FIG. 162. Plasmid 4101.
Figure 163:
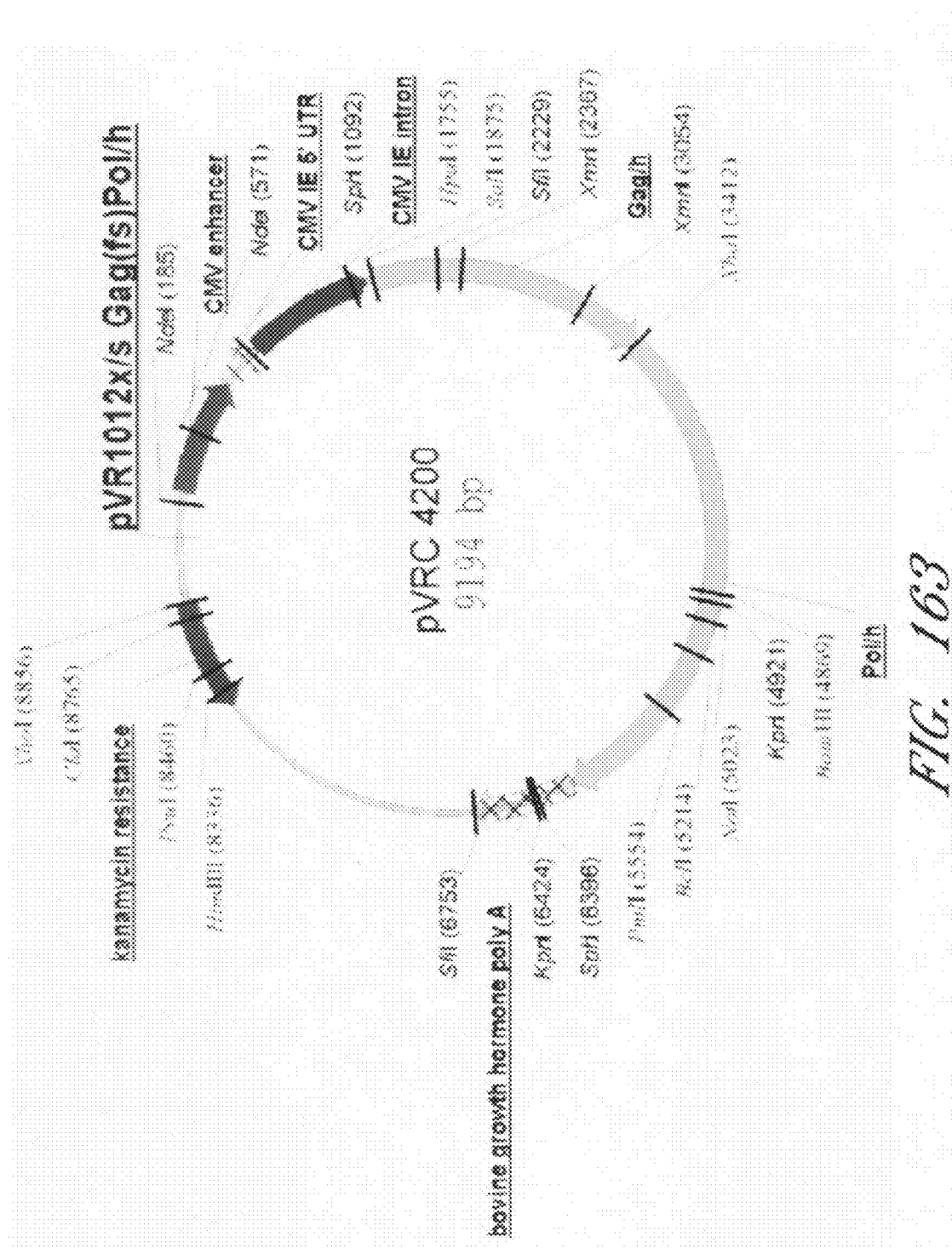
FIG. 163. Plasmid 4200.
Figure 164:
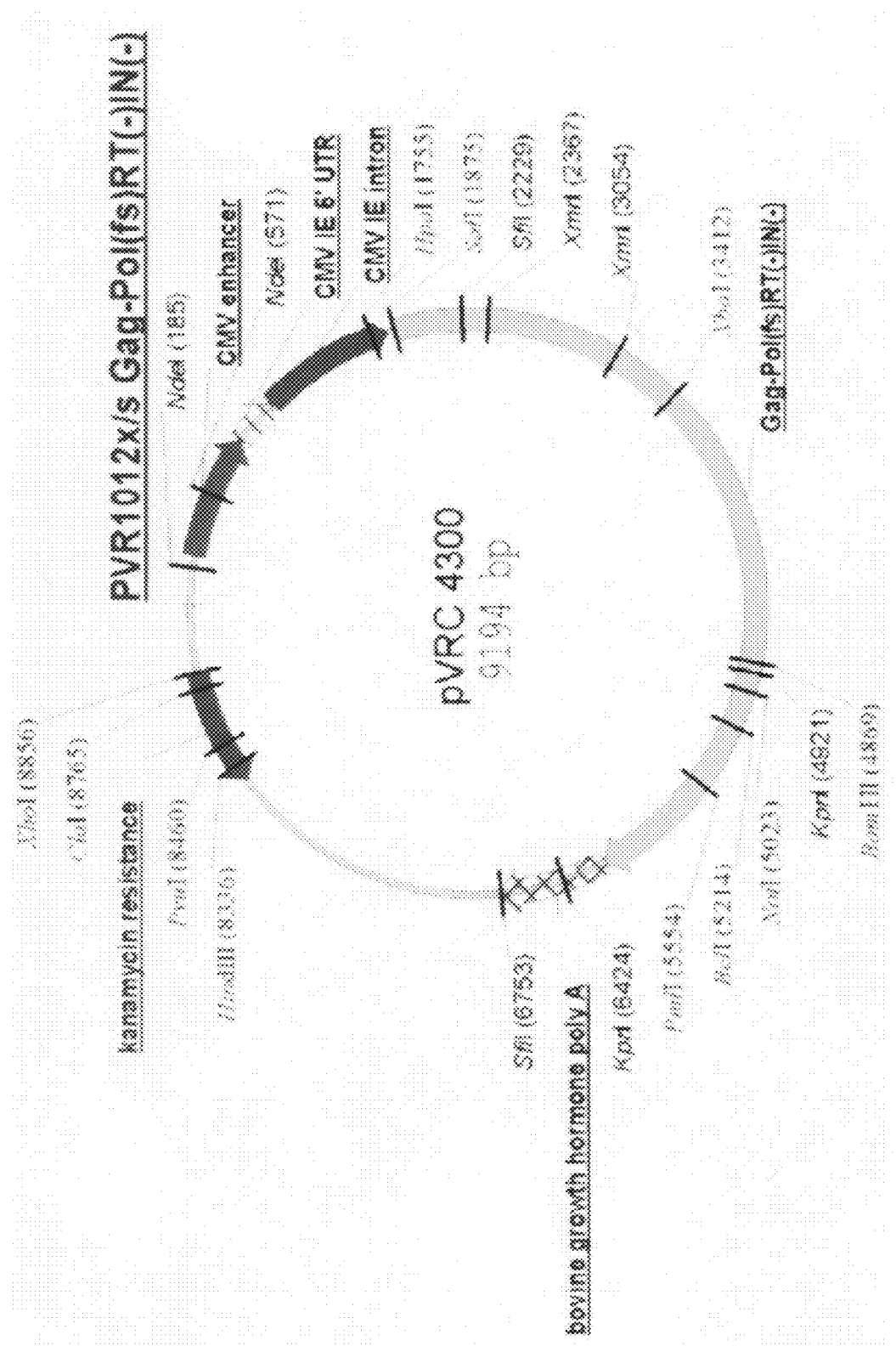
FIG. 164. Plasmid 4300.
Figure 165:
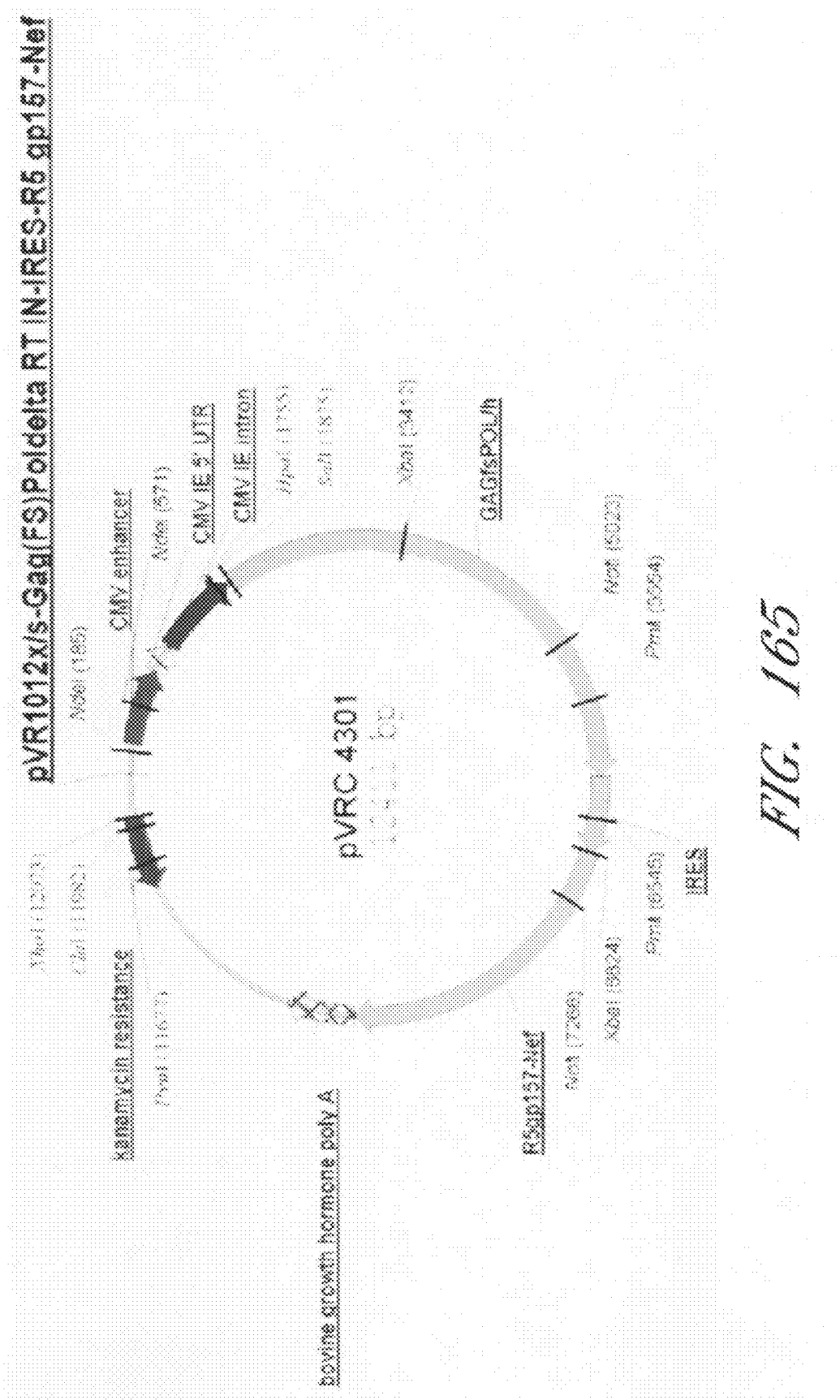
FIG. 165. Plasmid 4301.
Figure 166:
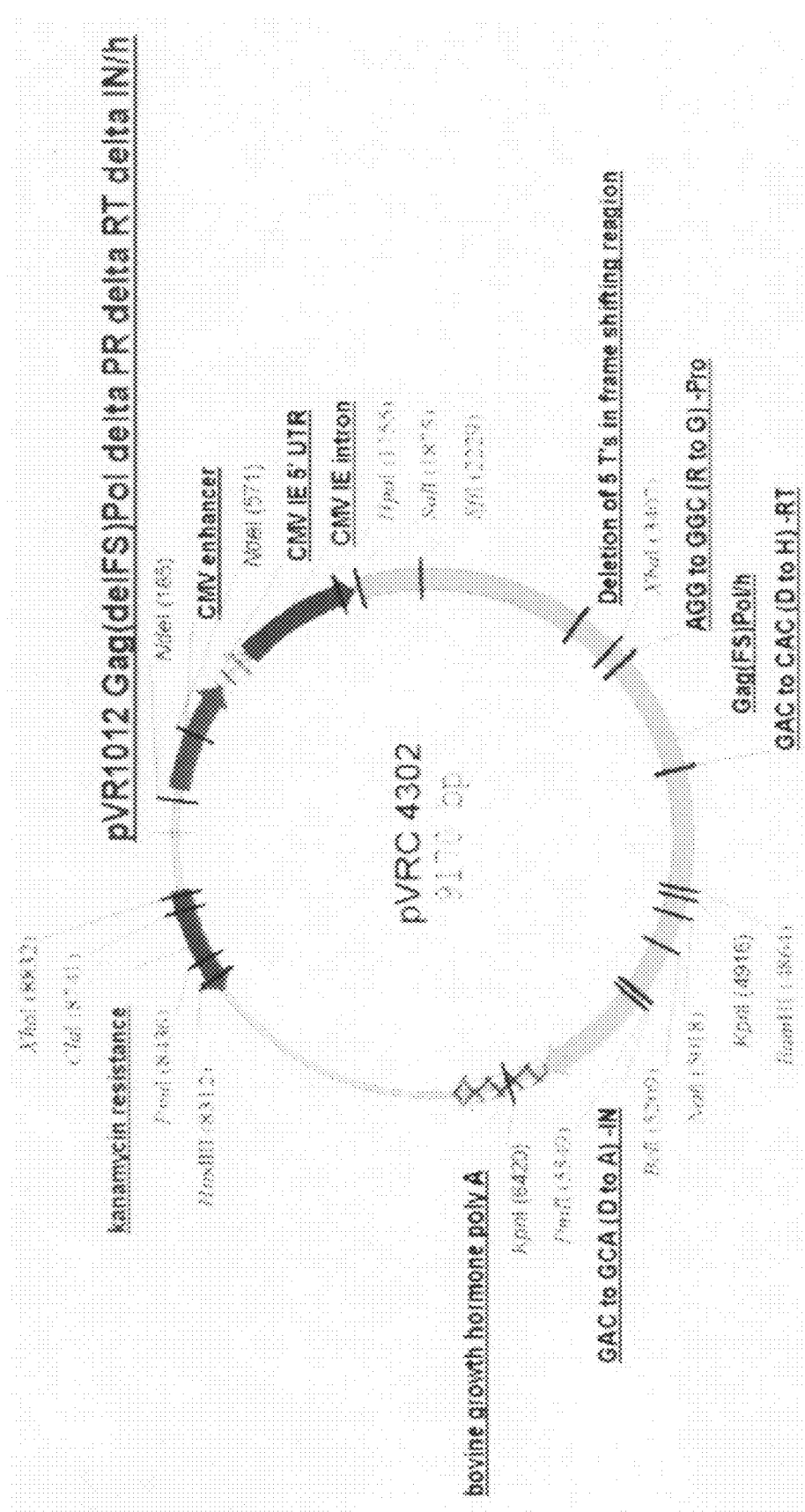
FIG. 166. Plasmid 4302.
Figure 167:
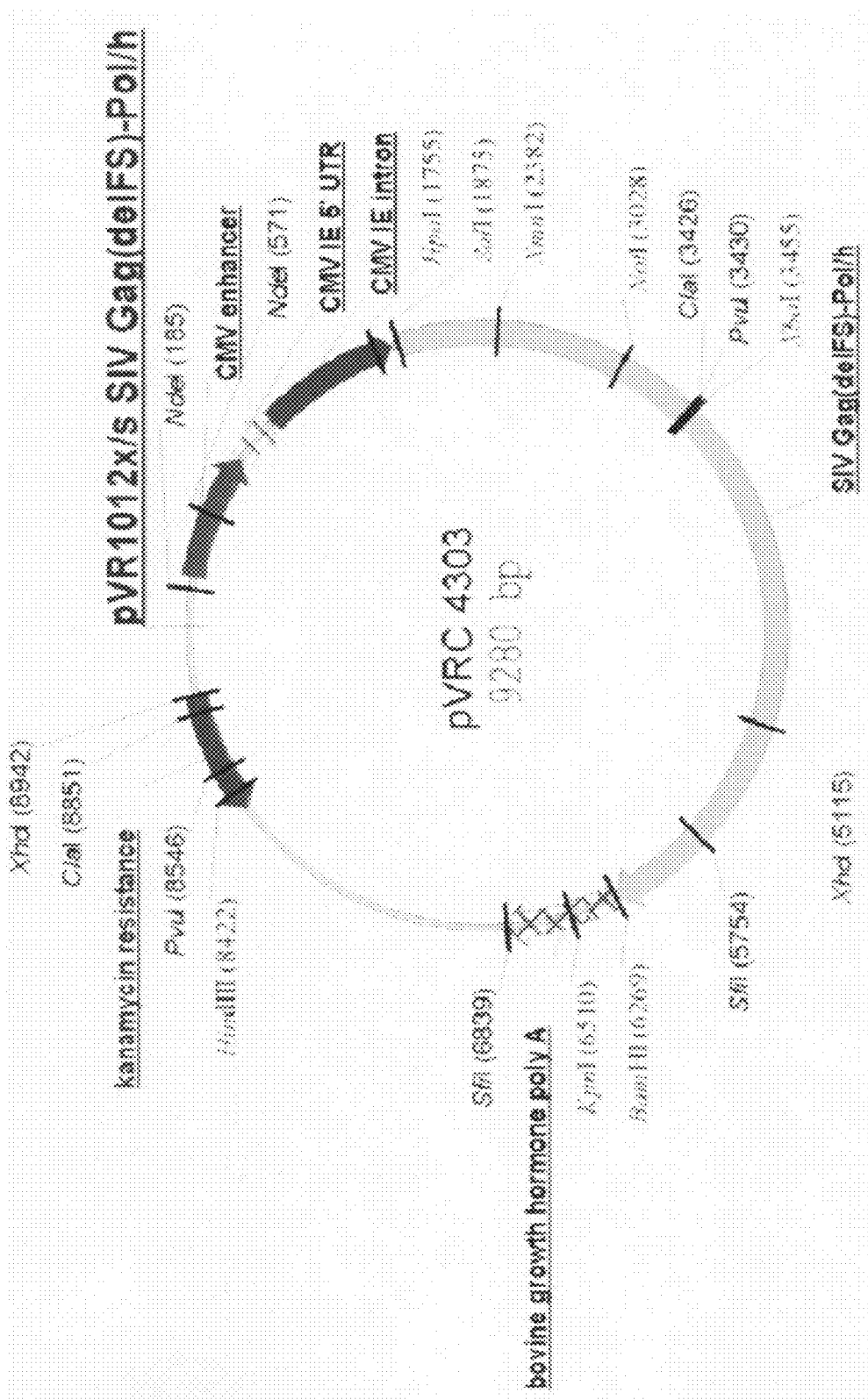
FIG. 167. Plasmid 4303.
Figure 168:
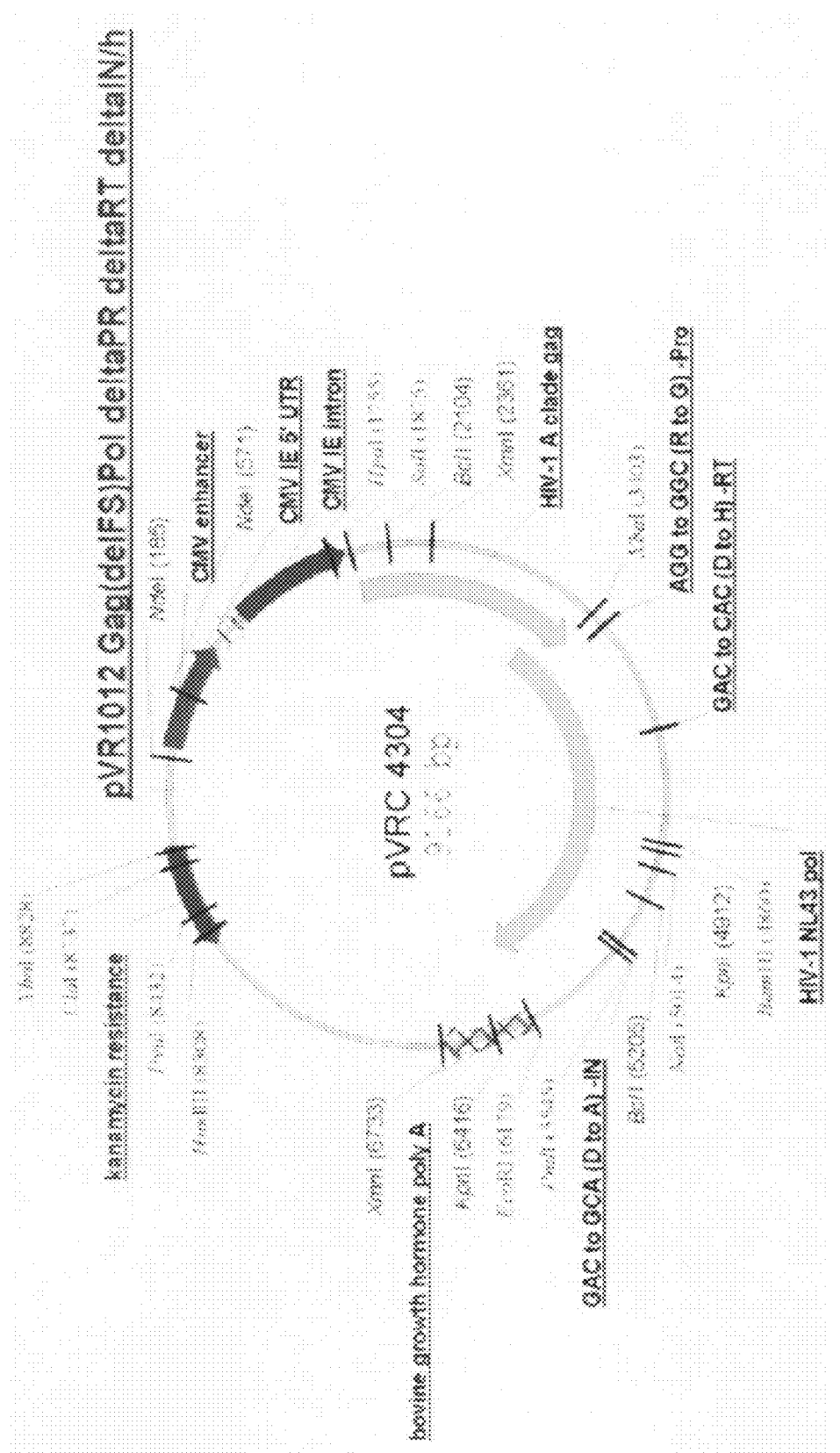
FIG. 168. Plasmid 4304.
Figure 169:
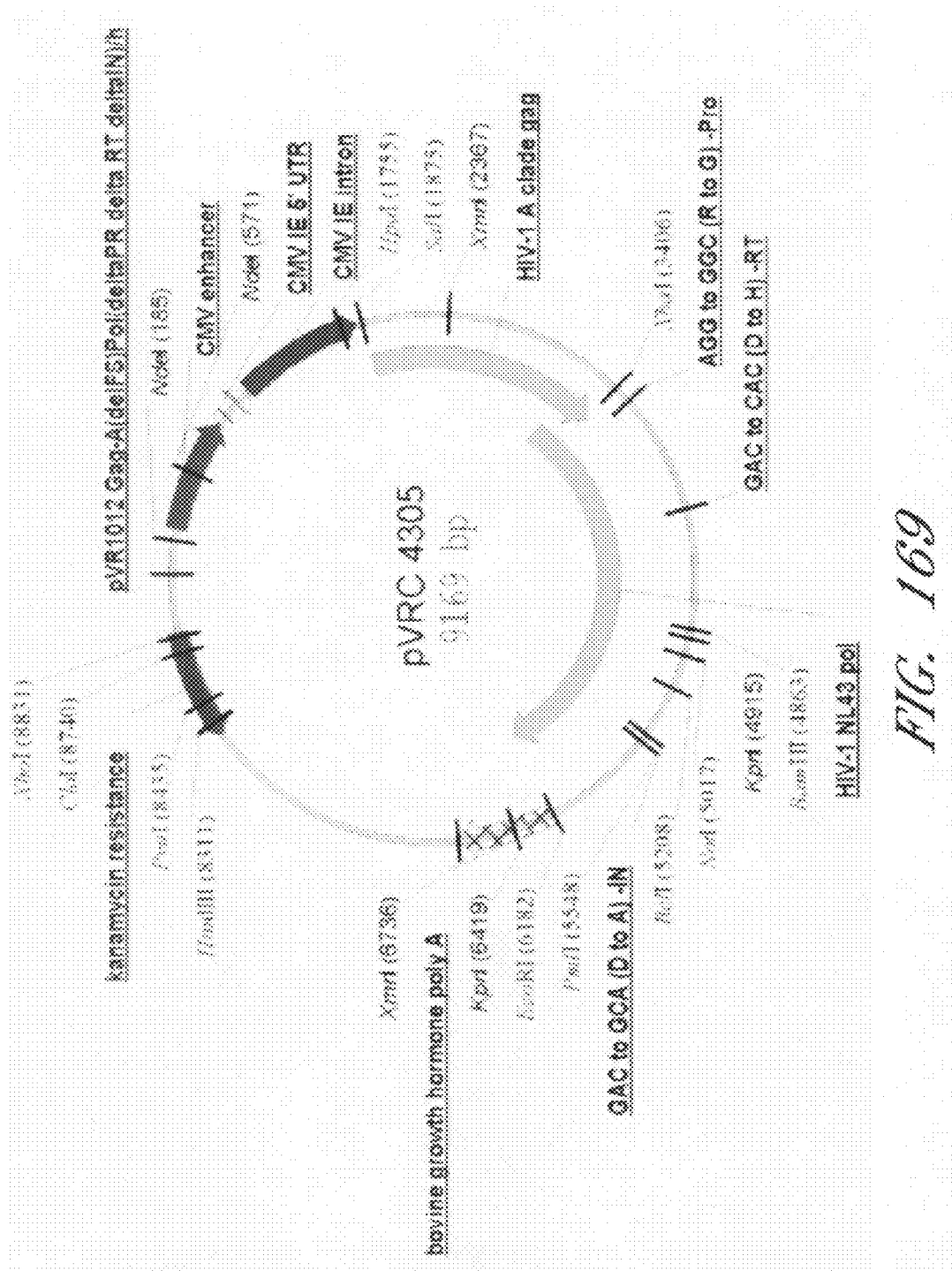
FIG. 169. Plasmid 4305.
Figure 170:
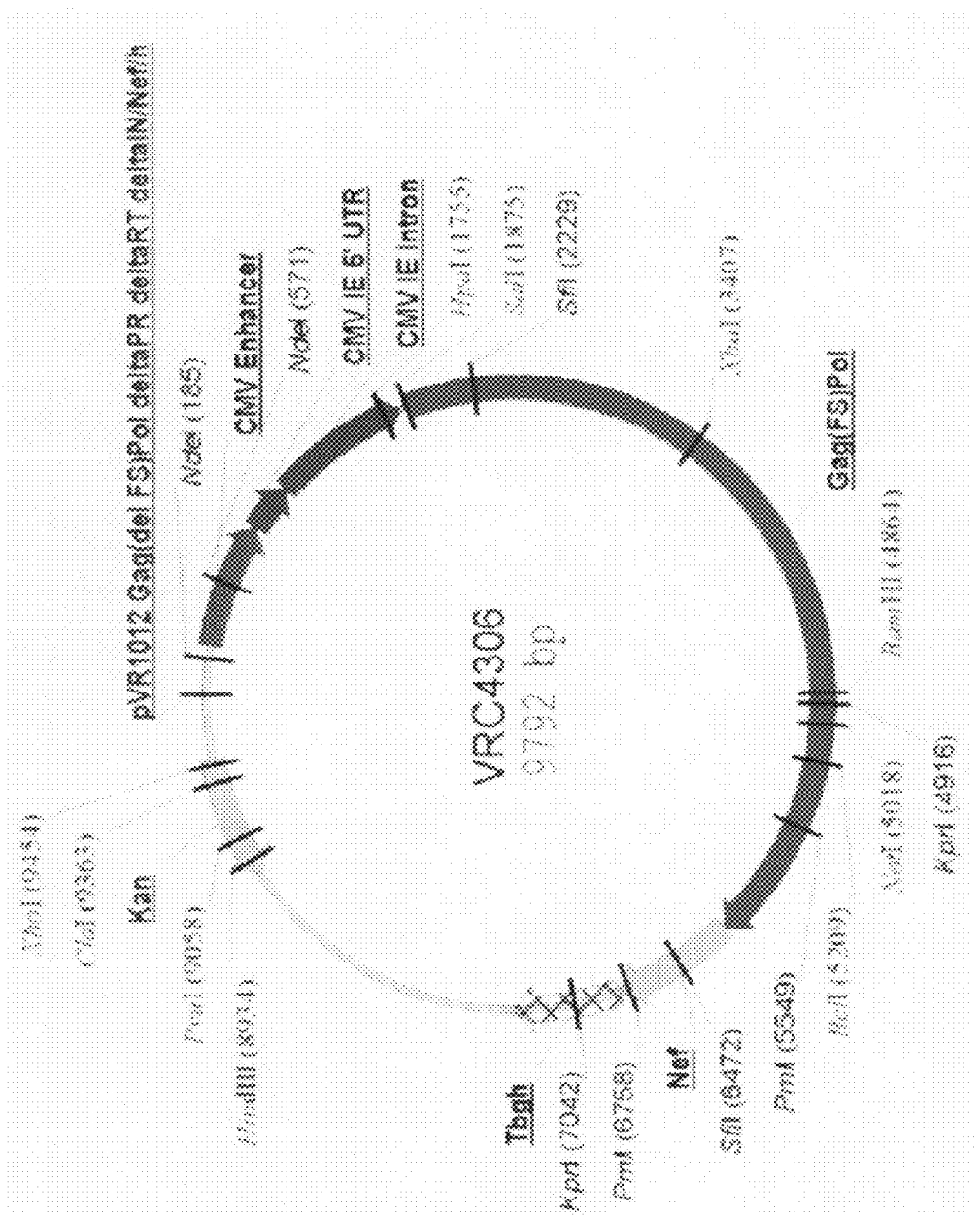
FIG. 170. Plasmid 4306.
Figure 171:
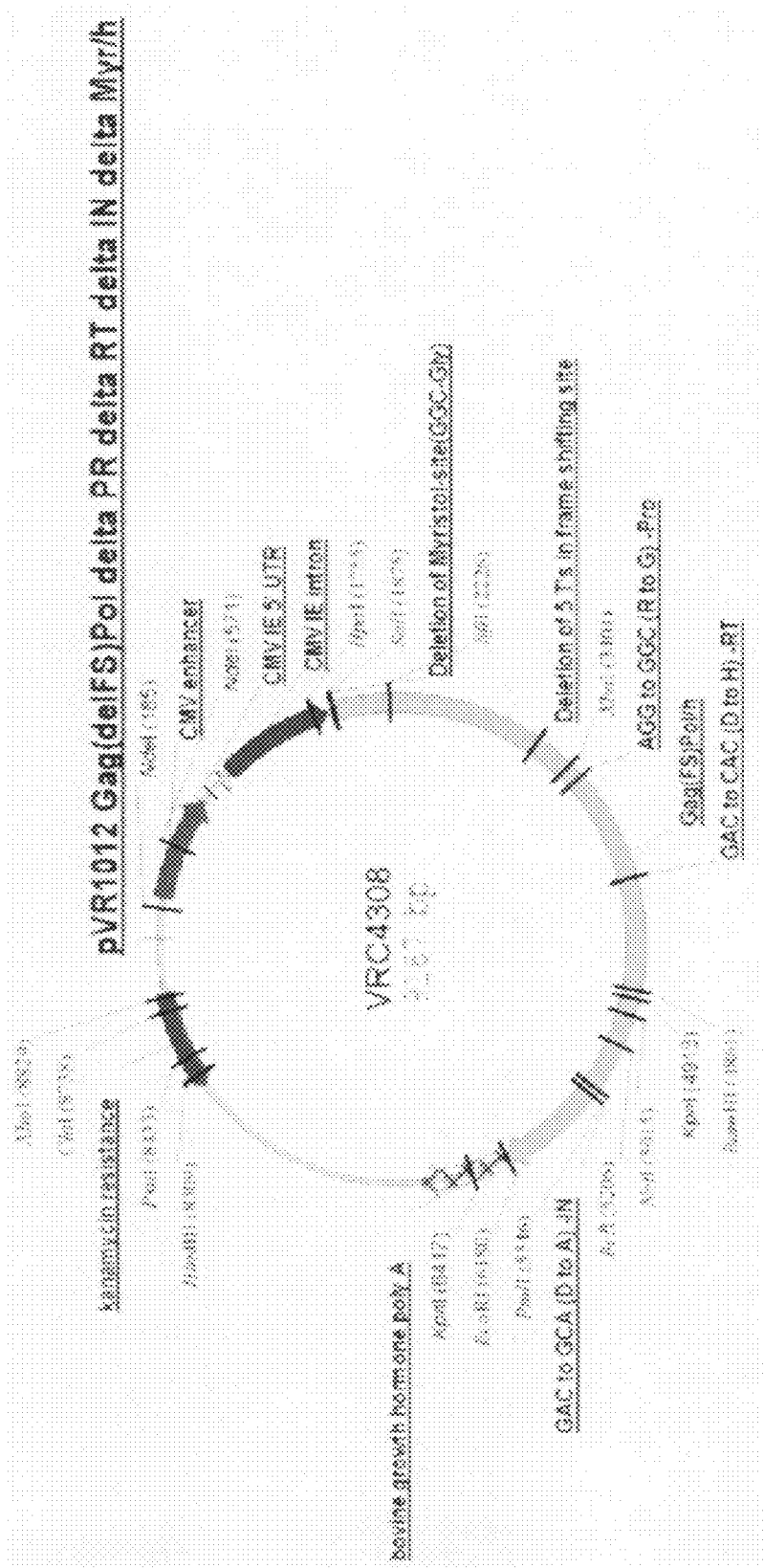
FIG. 171. Plasmid 4308.
Figure 172:
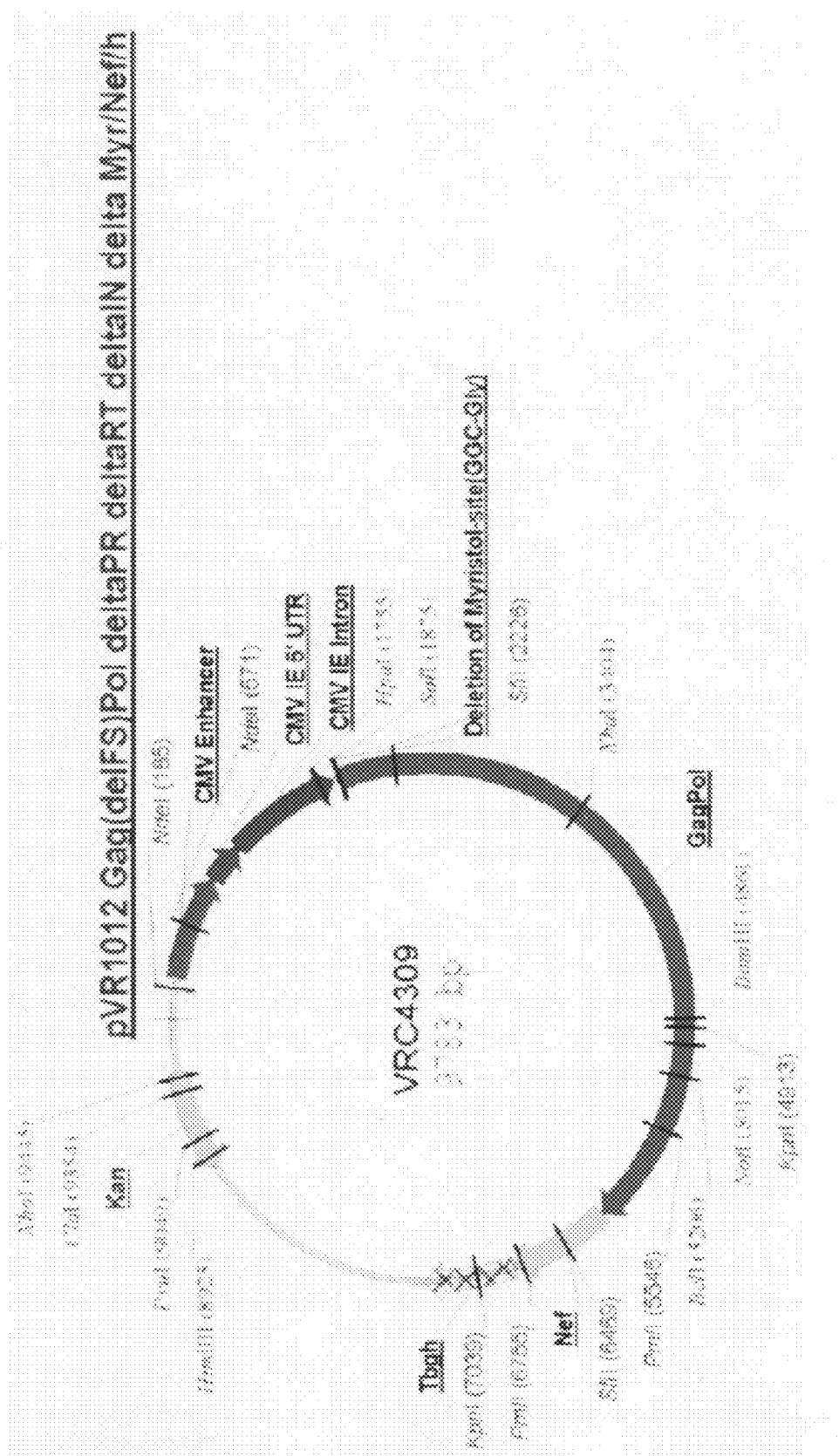
FIG. 172. Plasmid 4309.
Figure 173:
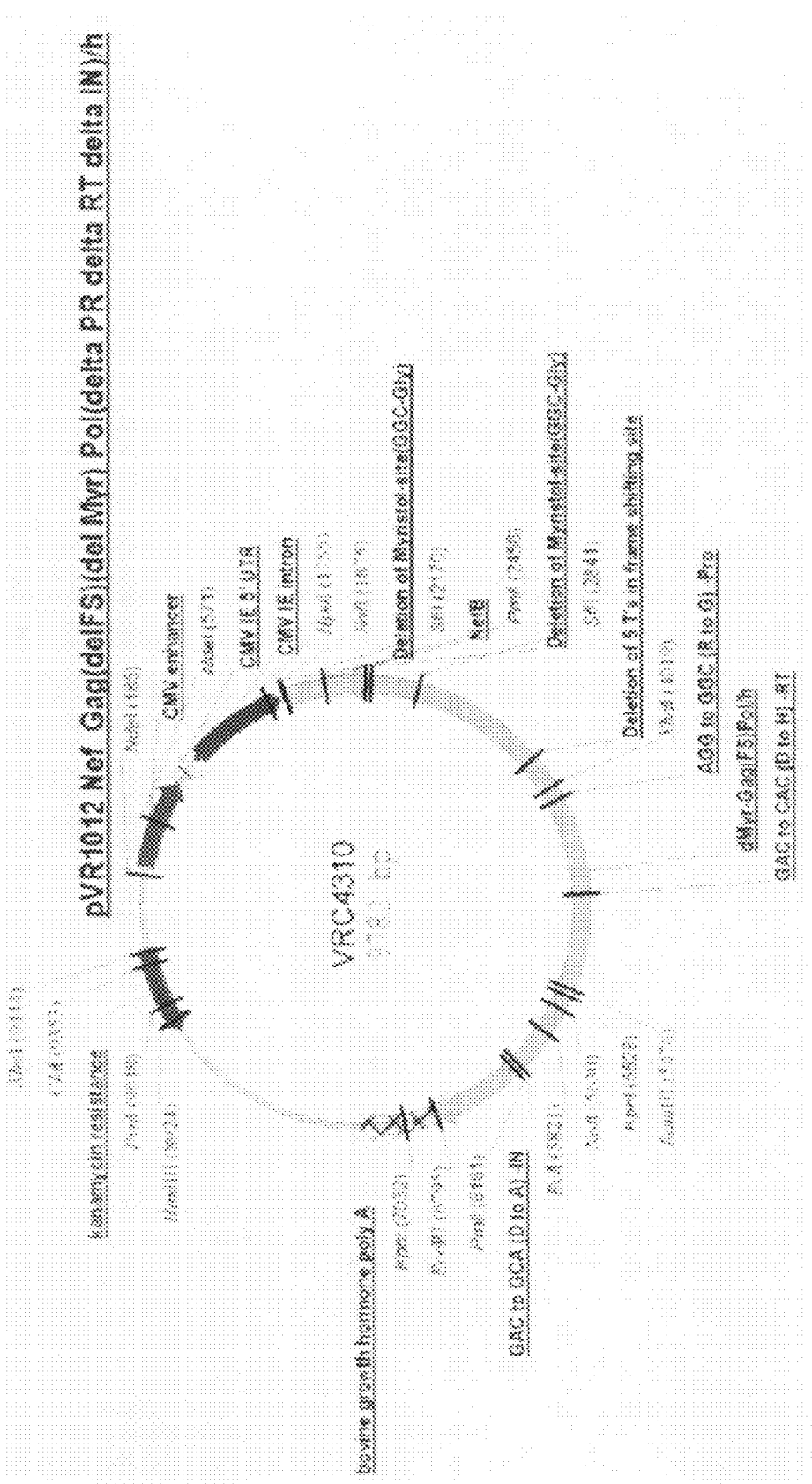
FIG. 173. Plasmid 4310.
Figure 174:
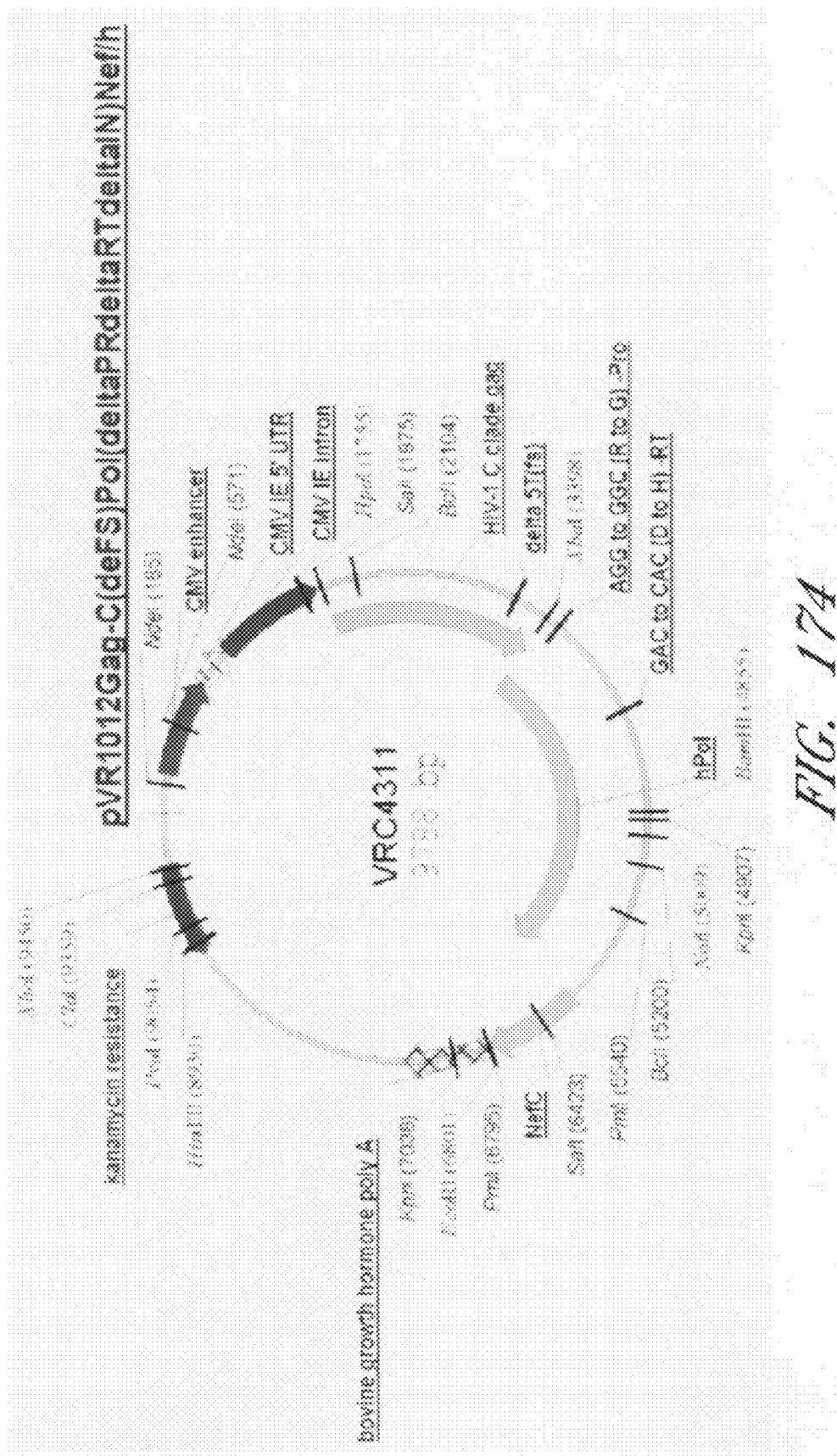
FIG. 174. Plasmid 4311.
Figure 175:
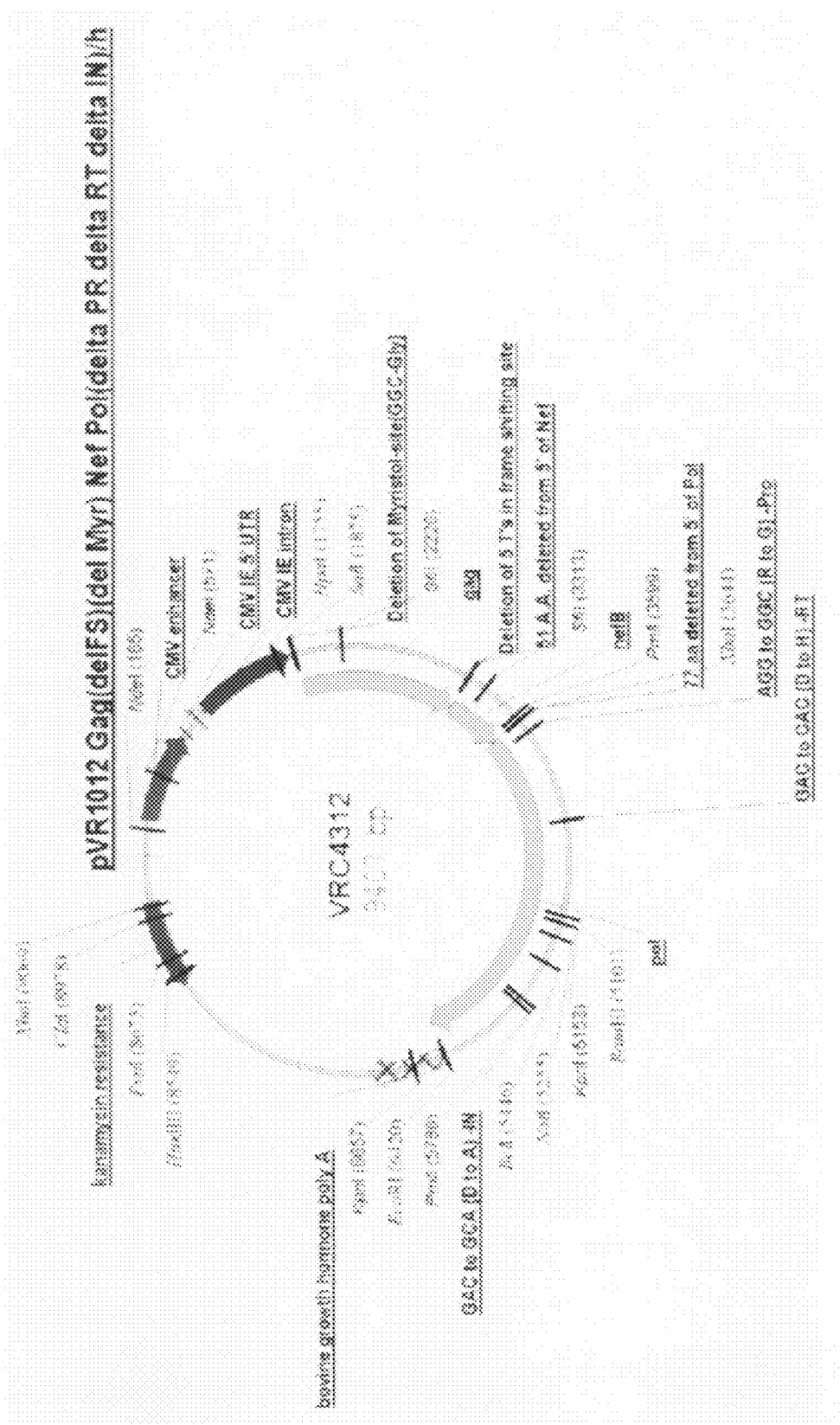
FIG. 175. Plasmid 4312.
Figure 176:
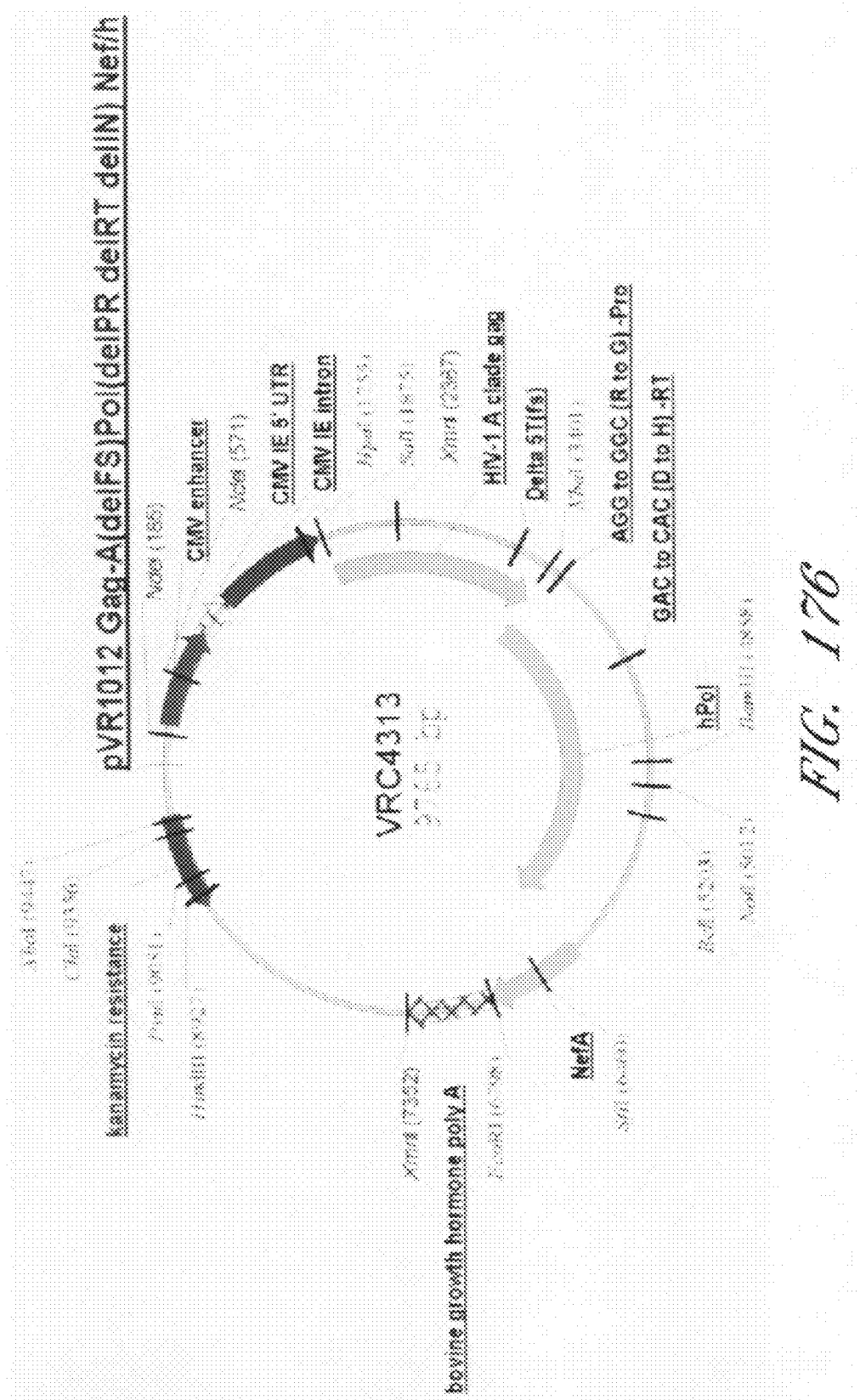

| Plasmid | Plasmid Name/Description | Plasmid Map Name | SEQ ID NO | Figure |
|---|---|---|---|---|
| | Env Plasmids | | | |
| 2100 | pVR1012x/s R5gp139-Nef(delta)MHC(delta)CD4/h | pVR1012x/s R5gp139-Nef delta MHC delta CD4/h | 1 | 1 |
| 2200 | pVR1012x/s R5gp157-Nef(delta)MHC(delta)CD4/h | pVR1012x/s R5gp157-Nef delta MHC delta CD4/h | 2 | 2 |
| 2300 | pVR1012x/s X4gp139-Nef delta MHC deltaCD4/h | pVR1012x/s X4gp139-Nef delta MHC delta CD4/h | 3 | 3 |
| 2302 | pVR1012x/s X4gp130-Nef/h | pVR1012x/s X4gp130-Nef/h | 4 | 4 |
| 2400 | pVR1012x/s X4gp157-NefDMHCDCD4/h | pVR1012x/s X4gp157-Nef delta MHC delta CD4/h | 5 | 5 |
| 2700 | pVR1012x/s X4gp140/h | pVR1012x/s X4gp140/h | 6 | 6 |
| 2701 | pVR1012x/s X4gp140 ACFI/h OR pVR1012x/s X4gp140(del F/CL del H IS)/h | pVR1012x/s X4gp140(del F/CL del H IS)/h | 7 | 7 |
| 2702 | pVR1012x/s X4gp128 ACFI/h OR pVR1012x/s X4gp128(del F/CL)/h | pVR1012x/s X4gp128(del F/CL)/h | 8 | 8 |
| 2706 | pVR1012x/s X4gp145/h | pVR1012x/s X4gp145/h | 9 | 9 |
| 2707 | pVR1012x/s X4gp145 ACFI/h OR pVR1012x/s X4gp145(del F/CL del H IS)/h | pVR1012x/s X4gp145(del F/CL del H IS)/h | 10 | 10 |
| 2800 | pVR1012x/s R5gp140/h | pVR1012x/s R5gp140/h | 11 | 11 |
| 2801 | pVR1012x/s R5gp140 ACFI/h OR pVR1012x/sR5gp140(del F/CL del H IS)/h | pVR1012x/sR5gp140(del F/CL del H IS)/h | 12 | 12 |
| 2804 | pVR1012x/s R5gp145/h | pVR1012x/s R5gp145/h | 13 | 13 |
| 2805 | pVR1012x/s R5gp145 ACFI/h OR pVR1012x/s R5gp145(del F/CL del H IS)/h | pVR1012x/sR5gp145(del F/CL del H IS)/h | 14 | 14 |
| 2810 | pVR1012x/s R5gp140delC1(delCFI)/h | pVR1012x/sR5gp140delC1(delCFI)/h | 15 | 15 |
| 2811 | pVR1012x/s R5gp140delC2(delCFI)/h | pVR1012x/sR5gp140delC2(delCFI)/h | 16 | 16 |
| 2812 | pVR1012x/s R5gp140delC3(delCFI)/h | pVR1012x/sR5gp140delC3(delCFI)/h | 17 | 17 |
| 2813 | pVR1012x/s R5gp140delC4(delCFI)/h | pVR1012x/sR5gp140delC4(delCFI)/h | 18 | 18 |
| 2814 | pVR1012x/s R5gp140delC5(delCFI)/h | pVR1012x/sR5gp140delC5(delCFI)/h | 19 | 19 |
| 2820 | pVR1012x/s R5gp140(dCFI)/dV1 | pVR1012x/s R5gp140(dCFI)dV1/h | 20 | 20 |
| 2821 | pVR1012x/s R5gp140(dCFI)/dV2 | pVR1012x/s gp140(dCFI)dV2/h | 21 | 21 |
| 2822 | pVR1012x/s R5gp140(dCFI)/dV3 | pVR1012x/s gp140(dCFI)dV3/h | 22 | 22 |
| 2823 | pVR1012x/s R5gp140(dCFI)/dV4 | pVR1012x/s R5gp140(dCFI)dV4/h | 23 | 23 |
| 2824 | pVR1012x/s R5gp140(dCFI)/dV12 | pVR1012x/s R5gp140(dCFI)dV12/h | 24 | 24 |
| 2825 | pVR1012x/s R5gp140(dCFI)/dV13 | pVR1012x/s R5gp140(dCFI)dV13/h | 25 | 25 |
| 2826 | pVR1012x/s R5gp140(dCFI)/dV14 | pVR1012x/s R5gp140(dCFI)dV14/h | 26 | 26 |
| 2827 | pVR1012x/s R5gp140(dCFI)/dv23 | pVR1012x/s R5gp140(dCFI)dv23/h | 27 | 27 |
| 2828 | pVR1012x/s R5gp140(dCFI)/dv24 | pVR1012x/s R5gp140(dCFI)dv24/h | 28 | 28 |
| 2829 | pVR1012x/s R5gp140(dCFI)/dv34 | pVR1012x/s R5gp140(dCFI)dv34/h | 29 | 29 |
| 2830 | pVR1012x/s R5gp140(dCFI)/dv123 | pVR1012x/s R5gp140(dCFI)dv123/h | 30 | 30 |
| 2831 | pVR1012x/s R5gp140(dCFI)/dv124 | pVR1012x/s R5gp140(dCFI)dv124/h | 31 | 31 |
| 2832 | pVR1012x/s R5gp140(dCFI)/dv134 | pVR1012x/s R5gp140(dCFI)dv134/h | 32 | 32 |
| 2833 | pVR1012x/s R5gp140(dCFI)/dv234 | pVR1012x/s R5gp140(dCFI)dv234/h | 33 | 33 |
| 2834 | pVR1012x/s R5gp140(dCFI)/dV1234 | pVR1012x/s R5gp140(dCFI)dv1234/h | 34 | 34 |
| 2835 | pAdApt R5gp140(dCFI)/dV1 | pAdApt CMV TbGH(+)R5gp140(dCFI)dv1/h | 35 | 35 |
| 2836 | pAdApt R5gp140(dCFI)/dV2 | pAdApt CMV TbGH(+)R5gp140(dCFI)dv2/h | 36 | 36 |
| 2837 | pAdApt R5gp140(dCFI)/dV3 | pAdApt CMV TbGH(+)R5gp140(dCFI)dv3/h | 37 | 37 |
| 2838 | pAdApt R5gp140(dCFI)/dV4 | pAdApt CMV TbGH(+)R5gp140(dCFI)dv4/h | 38 | 38 |
| 2839 | pAdApt R5gp140(dCFI)/dV12 | pAdApt CMV TbGH(+)R5gp140(dCFI)dv12/h | 39 | 39 |
| 2840 | pAdApt R5gp140(dCFI)/dV13 | pAdApt CMV TbGH(+)R5gp140(dCFI)dv13/h | 40 | 40 |
| 2841 | pAdApt R5gp140(dCFI)/dV14 | pAdApt CMV TbGH(+)R5gp140(dCFI)dv14/h | 41 | 41 |
| 2842 | pAdApt R5gp140(dCFI)/dV23 | pAdApt CMV TbGH(+)R5gp140(dCFI)dv23/h | 42 | 42 |
| 2843 | pAdApt R5gp140(dCFI)/dV24 | pAdApt CMV TbGH(+)R5gp140(dCFI)dv24/h | 43 | 43 |
| 2844 | pAdApt R5gp140(dCFI)/dV34 | pAdApt CMV TbGH(+)R5gp140(dCFI)dv34/h | 44 | 44 |
| 2845 | pAdApt R5gp140(dCFI)/dV123 | pAdApt CMV TbGH(+)R5gp140(dCFI)dv123/h | 45 | 45 |
| 2846 | pAdApt R5gp140(dCFI)/dV124 | pAdApt CMV TbGH(+)R5gp140(dCFI)dv124/h | 46 | 46 |
| 2847 | pAdApt R5gp140(dCFI)/dV134 | pAdApt CMV TbGH(+)R5gp140(dCFI)dv134/h | 47 | 47 |
| 2848 | pAdApt R5gp140(dCFI)/dV234 | pAdApt CMV TbGH(+)R5gp140(dCFI)dv234/h | 48 | 48 |
| 2849 | pAdApt R5gp140(dCFI)/dV1234 | pAdApt CMV TbGH(+)R5gp140(dCFI)dv1234/h | 49 | 49 |
| 2850 | pVR1012x/s R5gp145delC1(delCFI)/h | pVR1012x/s R5gp145delC1(delCFI)/h | 50 | 50 |
| 2851 | pVR1012x/s R5gp145delC2(delCFI)/h | pVR1012x/s R5gp145delC2(delCFI)/h | 51 | 51 |
| 2852 | pVR1012x/s R5gp145delC3(delCFI)/h | pVR1012x/s R5gp145delC3(delCFI)/h | 52 | 52 |
| 2853 | pVR1012x/s R5gp145delC4(delCFI)/h | pVR1012x/s R5gp145delC4(delCFI)/h | 53 | 53 |
| 2854 | pVR1012x/s R5gp145delC5(delCFI)/h | pVR1012x/s R5gp145delC5(delCFI)/h | 54 | 54 |
| 2860 | pVR1012x/s R5gp145(dCFI)/h/dV1 | pVR1012x/s R5gp145(dCFI)dv1/h | 55 | 55 |
| 2861 | pVR1012x/s R5gp145(dCFI)/h/dV2 | pVR1012x/s R5gp145(dCFI)dv2/h | 56 | 56 |
| 2862 | pVR1012x/s R5gp145(dCFI)/h/dV3 | pVR1012x/s R5gp145(dCFI)dv3/h | 57 | 57 |
| 2863 | pVR1012x/s R5gp145(dCFI)/h/dV4 | pVR1012x/s R5gp145(dCFI)dv4/h | 58 | 58 |
| 2864 | pVR1012x/s R5gp145(dCFI)/h/dV12 | pVR1012x/s R5gp145(dCFI)dv12/h | 59 | 59 |
| 2865 | pVR1012x/s R5gp145(dCFI)/h/dV13 | pVR1012x/s R5gp145(dCFI)dv13/h | 60 | 60 |
| 2866 | pVR1012x/s R5gp145(dCFI)/h/dV14 | pVR1012x/s R5gp145(dCFI)dv14/h | 61 | 61 |
| 2867 | pVR1012x/s R5gp145(dCFI)/h/dV23 | pVR1012x/s R5gp145(dCFI)dv23/h | 62 | 62 |
| 2868 | pVR1012x/s R5gp145(dCFI)/h/dV24 | pVR1012x/s R5gp145(dCFI)dv24/h | 63 | 63 |
| 2869 | pVR1012x/s R5gp145(dCFI)/h/dV34 | pVR1012x/s R5gp145(dCFI)dv34/h | 64 | 64 |

TABLE 1-continued

| Plasmid | Plasmid Name/Description | Plasmid Map Name | SEQ ID NO | Figure |
|---|---|---|---|---|
| 2870 | pVR1012x/s R5gp145(dCFI)/h/dV134 | pVR1012x/s R5gp145(dCFI)dv134/h | 65 | 65 |
| 2871 | pVR1012x/s R5gp145(dCFI)/h/dV234 | pVR1012x/s R5gp145(dCFI)dv234/h | 66 | 66 |
| 2872 | pVR1012x/s R5gp145(dCFI)dv123/h | pVR1012x/s R5gp145(dCFI)dv123/h | 67 | 67 |
| 2873 | pVR1012x/s R5gp145(dCFI)/h/dV124 | pVR1012x/s R5gp145(dCFI)dv124/h | 68 | 68 |
| 2874 | pVR1012x/s R5gp145(dCFI)/h/dV1234 | pVR1012x/s R5gp145(dCFI)dv1234/h | 69 | 69 |
| 2900 | pVR1012x/s R5gp150/h | pVR1012x/s R5gp150/h | 70 | 70 |
| 3000 | pVR1012x/s R5gp160/h | pVR1012x/s R5gp160/h | 71 | 71 |
| 3200 | pVR1012x/s X4gp150/h | pVR1012x/s X4gp150/h | 72 | 72 |
| 3201 | pVR1012x/s X4gp150 ACFI/h OR pVR1012x/s X4gp150(del F/CL del H IS)/h | pVR1012x/s X4gp150(del F/CL del H IS)/h | 73 | 73 |
| 3202 | pVR1012x/s X4gp150 Agly/h | pVR1012x/s X4gp150 delta gly | 74 | 74 |
| 3203 | pVR1012x/s X4gp150 AB Agly/h | pVR1012x/s X4gp150 AB(delta)gly/h | 75 | 75 |
| 3300 | pVR1012x/s X4gp160/h | pVR1012x/s X4gp160/h | 76 | 76 |
| 3301 | pVR1012x/s X4gp160 ACFI/h OR pVR1012x/s X4gp160(del F/CL del H IS)/h | pVR1012x/s X4gp160(del F/CL del H IS)/h | 77 | 77 |
| 3400 | pVR1012x/s X4gp160 Agly/h | pVR1012x/s X4gp160 delta gly | 78 | 78 |
| 3401 | pVR1012x/s X4gp160 AB Agly/h OR pVR1012x/s X4gp160AB mut Agly/h | pVR1012x/s X4gp160 AB Dgly/h | 79 | 79 |
| 3500 | pVR1012x/s Nef/h | pVR1012x/s Nef/h | 80 | 80 |
| 3600 | pVR1012x/s NefDMHCDCD4/h | pVR1012x/s Nef delta MHC delta CD4/h | 81 | 81 |
| 3700 | pVR1012x/s NefDCD4/h | pVR1012x/s Nef delta CD4/h | 82 | 82 |
| 3800 | pVR1012x/s NefDMHC/h | pVR1012x/s Nef delta MHC/h | 83 | 83 |
| 5200 | pVR1012x/s 89.6Pgp128(del F/CL)/h | pVR1012x/s 89.6Pgp128(del F/CL)/h | 84 | 84 |
| 5201 | R5 Clade 89.6P gp140 ACFI/h | pVR1012x/s 89.6Pgp140(del F/CL del H IS)/h | 85 | 85 |
| 5202 | pVR1012x/s 89.6Pgp145(del F/CL del H IS)/h | pVR1012x/s 89.6Pgp145(del F/CL del H IS)/h | 86 | 86 |
| 5203 | pVR1012x/s 89.6Pgp160/h | pVR1012x/s 89.6Pgp160/h | 87 | 87 |
| 5300 | R5 Clade C gp140 ACFI/h OR pVR1012x/s R5 (cladeC)gp140(del F/CL del H IS)/h | pVR1012x/s CladeC(R5)gp140(del F/CL del H IS)/h | 88 | 88 |
| 5301 | pVR1012x/s R5(cladeC)gp145(del F/CL del H IS)/h | pVR1012x/s CladeC(R5)gp145(del F/CL del H IS)/h | 89 | 89 |
| 5303 | pVR1012x/s R5gp145 CladeC(Brazil)delCFI/h | pVR1012x/s R5gp145 CladeC(Brazil)delCFI/h | 90 | 90 |
| 5304 | pVR1012x/s R5(clade A)gp140(del F/CL del H IS)/h | pVR1012x/s R5gp140CladeA(dCFI)/h | 91 | 91 |
| 5305 | pVR1012x/s R5(clade A)gp145(del F/CL del H IS)/h | pVR1012x/s R5gp145CladeA(dCFI)/h | 92 | 92 |
| 5306 | pVR1012x/s R5(clade E)gp140(del F/CL del H IS)/h | pVR1012x/s R5gp140CladeE(dCFI)/h | 93 | 93 |
| 5307 | pVR1012x/s R5(clade E)gp145(del F/CL del H IS)/h | pVR1012x/s R5gp145CladeE(dCFI)/h | 94 | 94 |
| 5308 | pVR1012x/s R5(clade C South African)gp140(del F/CL del H IS)/h | pVR1012x/s R5gp140 CladeC(SA)(dCFI)/h | 95 | 95 |
| 5309 | pVR1012x/s R5(clade C South African)gp145(del F/CL del H IS)/h | pVR1012x/s R5gp145 CladeC(SA)(dCFI)/h | 96 | 96 |
| 5350 | pVRC1012(x/s)-gp140(dCFI)(Brazil C)/dV1 | pVR1012x/s R5gp140CladeC(Brazil)dCFIdv1/h | 97 | 97 |
| 5351 | pVRC1012(x/s)-gp140(dCFI)(Brazil C)/dV12 | pVR1012x/s R5gp140CladeC(Brazil)(dCFI)dv12/h | 98 | 98 |
| 5352 | pVRC1012(x/s)-gp140(dCFI)(Brazil C)/dV123 | pVR1012x/s R5gp140CladeC(Brazil)(dCFI)dv123/h | 99 | 99 |
| 5353 | pVRC1012(x/s)-gp140(dCFI)(Brazil C)/dV1234 | pVR1012x/s R5gp140CladeC(Brazil)(dCFI)dv1234/h | 100 | 100 |
| 5354 | pVRC1012(x/s)-gp140(dCFI)(Brazil C)/dV124 | pVR1012x/s R5gp140CladeC(Brazil)(dCFI)dv124/h | 101 | 101 |
| 5355 | pVRC1012(x/s)-gp140(dCFI)(Brazil C)/dV13 | pVR1012x/s R5gp140CladeC(Brazil)(dCFI)dv13/h | 102 | 102 |
| 5356 | pVRC1012(x/s)-gp140(dCFI)(Brazil C)/dV134 | pVR1012x/s R5gp140CladeC(Brazil)(dCFI)dv134/h | 103 | 103 |
| 5357 | pVRC1012(x/s)-gp140(dCFI)(Brazil C)/dV14 | pVR1012x/s R5gp140CladeC(Brazil)(dCFI)dv14/h | 104 | 104 |
| 5358 | pVRC1012(x/s)-gp140(dCFI)(Brazil C)/dV2 | pVR1012x/s R5gp140CladeC(Brazil)(dCFI)dv2/h | 105 | 105 |
| 5359 | pVRC1012(x/s)-gp140(dCFI)(Brazil C)/dV23 | pVR1012x/s R5gp140CladeC(Brazil)(dCFI)dv23/h | 106 | 106 |
| 5360 | pVRC1012(x/s)-gp140(dCFI)(Brazil C)/dV234 | pVR1012x/s R5gp140CladeC(Brazil)(dCFI)dv234/h | 107 | 107 |
| 5361 | pVRC1012(x/s)-gp140(dCFI)(Brazil C)/dV24 | pVR1012x/s R5gp140CladeC(Brazil)(dCFI)dv24/h | 108 | 108 |
| 5362 | pVRC1012(x/s)-gp140(dCFI)(Brazil C)/dV3 | pVR1012x/s R5gp140CladeC(Brazil)(dCFI)dv3/h | 109 | 109 |
| 5363 | pVRC1012(x/s)-gp140(dCFI)(Brazil C)/dV34 | pVR1012x/s R5gp140CladeC(Brazil)(dCFI)dv34/h | 110 | 110 |
| 5364 | pVRC1012(x/s)-gp140(dCFI)(Brazil C)/dV4 | pVR1012x/s R5gp140CladeC(Brazil)(dCFI)dv4/h | 111 | 111 |
| 5365 | PVRC1012(x/s)-gp145(dCFI)(Brazil C)/dV1 | pVR1012x/s R5gp145CladeC(Brazil)(dCFI)dv1/h | 112 | 112 |
| 5366 | PVRC1012(x/s)-gp145(dCFI)(Brazil C)/dV12 | pVR1012x/s R5gp145CladeC(Brazil)(dCFI)dv12/h | 113 | 113 |
| 5367 | PVRC1012(x/s)-gp145(dCFI)(Brazil C)/dV123 | pVR1012x/s R5gp145CladeC(Brazil)(dCFI)dv123/h | 114 | 114 |
| 5368 | PVRC1012(x/s)-gp145(dCFI)(Brazil C)/dV1234 | pVR1012x/s R5gp145CladeC(Brazil)(dCFI)dv1234/h | 115 | 115 |
| 5369 | PVRC1012(x/s)-gp145(dCFI)(Brazil C)/dV124 | pVR1012x/s R5gp145CladeC(Brazil)(dCFI)dv124/h | 116 | 116 |
| 5370 | PVRC1012(x/s)-gp145(dCFI)(Brazil C)/dV13 | pVR1012x/s R5gp145CladeC(Brazil)(dCFI)dv13/h | 117 | 117 |
| 5371 | PVRC1012(x/s)-gp145(dCFI)(Brazil C)/dV134 | pVR1012x/s R5gp145CladeC(Brazil)(dCFI)dv134/h | 118 | 118 |
| 5372 | PVRC1012(x/s)-gp145(dCFI)(Brazil C)/dV14 | pVR1012x/s R5gp145CladeC(Brazil)(dCFI)dv14/h | 119 | 119 |
| 5373 | PVRC1012(x/s)-gp145(dCFI)(Brazil C)/dV2 | pVR1012x/s R5gp145CladeC(Brazil)(dCFI)dv2/h | 120 | 120 |
| 5374 | PVRC1012(x/s)-gp145(dCFI)(Brazil C)/dV23 | pVR1012x/s R5gp145CladeC(Brazil)(dCFI)dv23/h | 121 | 121 |
| 5375 | PVRC1012(x/s)-gp145(dCFI)(Brazil C)/dV234 | pVR1012x/s R5gp145CladeC(Brazil)(dCFI)dv234/h | 122 | 122 |
| 5376 | PVRC1012(x/s)-gp145(dCFI)(Brazil C)/dV24 | pVR1012x/s R5gp145CladeC(Brazil)(dCFI)dv24/h | 123 | 123 |
| 5377 | PVRC1012(x/s)-gp145(dCFI)(Brazil C)/dV3 | pVR1012x/s R5gp145CladeC(Brazil)(dCFI)dv3/h | 124 | 124 |
| 5378 | PVRC1012(x/s)-gp145(dCFI)(Brazil C)/dV34 | pVR1012x/s R5gp145CladeC(Brazil)(dCFI)dv34/h | 125 | 125 |
| 5379 | PVRC1012(x/s)-gp145(dCFI)(Brazil C)/dV4 | pVR1012x/s R5gp145CladeC(Brazil)(dCFI)dv4/h | 126 | 126 |
| 5500 | pVR1012x/s R5(SA-C)gp140(dCFI)dV1/h | pVR1012x/s R5gp140(dCFI)SA dv1/h | 127 | 127 |
| 5501 | pVR1012x/s R5(SA-C)gp140(dCFI)dV12/h | pVR1012x/s R5gp140(dCFI)SA dv12/h | 128 | 128 |
| 5502 | pVR1012x/s R5(SA-C)gp140(dCFI)dV123/h | pVR1012x/s R5gp140(dCFI)SA dv123/h | 129 | 129 |
| 5503 | pVR1012x/s R5(SA-C)gp140(dCFI)dV1234/h | pVR1012x/s R5gp140(dCFI)SA dv1234/h | 130 | 130 |
| 5504 | pVR1012x/s R5(SA-C)gp140(dCFI)dV124/h | pVR1012x/s R5gp140(dCFI)SA dv124/h | 131 | 131 |
| 5505 | pVR1012x/s R5(SA-C)gp140(dCFI)dV13/h | pVR1012x/s R5gp140(dCFI)SA dv13/h | 132 | 132 |
| 5506 | pVR1012x/s R5(SA-C)gp140(dCFI)dV134/h | pVR1012x/s R5gp140(dCFI)SA dv134/h | 133 | 133 |
| 5507 | pVR1012x/s R5(SA-C)gp140(dCFI)dV14/h | pVR1012x/s R5gp140(dCFI)SA dv14/h | 134 | 134 |

TABLE 1-continued

| Plasmid | Plasmid Name/Description | Plasmid Map Name | SEQ ID NO | Figure |
|---|---|---|---|---|
| 5508 | pVR1012x/s R5(SA-C)gp140(dCFI)dV2/h | pVR1012x/s R5gp140(dCFI)SA dv2/h | 135 | 135 |
| 5509 | pVR1012x/s R5(SA-C)gp140(dCFI)dV23/h | pVR1012x/s R5gp140(dCFI)SA dv23/h | 136 | 136 |
| 5510 | pVR1012x/s R5(SA-C)gp140(dCFI)dV234/h | pVR1012x/s R5gp140(dCFI)SA dv234/h | 137 | 137 |
| 5511 | pVR1012x/s R5(SA-C)gp140(dCFI)dV24/h | pVR1012x/s R5gp140(dCFI)SA dv24/h | 138 | 138 |
| 5512 | pVR1012x/s R5(SA-C)gp140(dCFI)dV3/h | pVR1012x/s R5gp140(dCFI)SA dv3/h | 139 | 139 |
| 5513 | pVR1012x/s R5(SA-C)gp140(dCFI)dV34/h | pVR1012x/s R5gp140(dCFI)SA dv34/h | 140 | 140 |
| 5514 | pVR1012x/s R5(SA-C)gp140(dCFI)dV4/h | pVR1012x/s R5gp140(dCFI)SA dv4/h | 141 | 141 |
| 5515 | pVR1012x/s R5(SA-C)gp145(dCFI)dV1/h | pVR1012x/s R5gp145(dCFI)SA dv1/h | 142 | 142 |
| 5516 | pVR1012x/s R5(SA-C)gp145(dCFI)dV12/h | pVR1012x/s R5gp145(dCFI)SA dv12/h | 143 | 143 |
| 5517 | pVR1012x/s R5(SA-C)gp145(dCFI)dV123/h | pVR1012x/s R5gp145(dCFI)SA dv123/h | 144 | 144 |
| 5518 | pVR1012x/s R5(SA-C)gp145(dCFI)dV1234/h | pVR1012x/s R5gp145(dCFI)SA dv1234/h | 145 | 145 |
| 5519 | pVR1012x/s R5(SA-C)gp145(dCFI)dV2/h | pVR1012x/s R5gp145(dCFI)SA dv2/h | 146 | 146 |
| 5520 | pVR1012x/s R5(SA-C)gp145(dCFI)dV23/h | pVR1012x/s R5gp145(dCFI)SA dv23/h | 147 | 147 |
| 5521 | pVR1012x/s R5(SA-C)gp145(dCFI)dV234/h | pVR1012x/s R5gp145(dGFI)SA dv234/h | 148 | 148 |
| 5522 | pVR1012x/s R5(SA-C)gp145(dCFI)dV24/h | pVR1012x/s R5gp145(dCFI)SA dv24/h | 149 | 149 |
| 5523 | pVR1012x/s R5(SA-C)gp145(dCFI)dV3/h | pVR1012x/s R5gp145(dCFI)SA dv3/h | 150 | 150 |
| 5524 | pVR1012x/s R5(SA-C)gp145(dCFI)dV34/h | pVR1012x/s R5gp145(dCFI)SA dv34/h | 151 | 151 |
| 5525 | pVR1012x/s R5(SA-C)gp145(dCFI)dV4/h | pVR1012x/s R5gp145(dCFI)SA dv4/h | 152 | 152 |
| 5526 | pVR1012x/s R5(SA-C)gp145(dCFI)dV13/h | pVR1012x/s R5gp145(dCFI)SA dv13/h | 153 | 153 |
| 5527 | pVR1012x/s R5(SA-C)gp145(dCFI)dV134/h | pVR1012x/s R5gp145(dCFI)SA dv134/h | 154 | 154 |
| 5528 | pVR1012x/s R5(SA-C)gp145(dCFI)dV124/h | pVR1012x/s R5gp145(dCFI)SA dv124/h | 155 | 155 |
| 5529 | pVR1012x/s R5(SA-C)gp145(dCFI)dV14/h | pVR1012x/s R5gp145(dCFI)SA dv14/h | 156 | 156 |
| | Gag/Pol Plasmids | | | |
| 3900 | pVR1012x/s HIV Gag/h | pVR1012x/s Gag/h | 157 | 157 |
| 3901 | pVR1012x/s SIV Gag/h | pVR1012x/s SIV Gag/h | 158 | 158 |
| 4000 | pVR1012x/s HIV Gag-Pol AFS APR/h OR pVR1012x/s Gag-Pol/h | pVR1012x/s Gag-PoldeltaFSdeltaPr/h | 159 | 159 |
| 4001 | pVR1012x/s SIV Gag-Pol/h | pVR1012x/s SIV Gag-Pol/h | 160 | 160 |
| 4100 | pVR1012x/s HIV Pol/h | pVR1012x/s Pol/h | 161 | 161 |
| 4101 | pVR1012x/s SIV Pol/h | pVR1012x/s SIV Pol/h | 162 | 162 |
| 4200 | pVR1012x/s HIV Gag-Pol/h | pVR1012x/s Gag(fs)Pol/h | 163 | 163 |
| 4300 | pVR1012x/s HIV Gag-Pol ART AIN/h OR pVR1012 Gag-Pol(d delta RT delta IN)/h | pVR1012x/s Gag-Pol(fs)RT(−)/IN(−) | 164 | 164 |
| 4301 | pVR1012x/s-Gag(FS)-Pol-delta RT IN-IRES-R5gp157-Nef | pVR1012x/s-Gag(FS)-Pol-delta RT IN-IRES-R5gp157-Nef | 165 | 165 |
| 4302 | pVR1012x/s HIV gag-Pol AFS APR ART AIN/h | pVR1012x/s Gag(delFS)Pol(delta PR delta RT delta IN)/h | 166 | 166 |
| 4303 | pVR1012x/s SIV Gag-Pol AFS/h OR pVR1012 SIV Gag(delFS)Pol(delta PR delta RT delta IN)/h | pVR1012x/s SIV Gag(delFS)-Pol/h | 167 | 167 |
| 4304 | pVR1012 Gag(delFS)Pol delta PR delta RT delta IN/h | pVR1012 Gag-C(delFS)Pol(deltaPR deltaRT deltaIN)/h | 168 | 168 |
| 4305 | pVR1012 Gag-A(delFS)Pol(delta PR delta RT delta IN)/h | pVR1012 Gag-A(delFS)Pol(deltaPR deltaRT deltaIN)/h | 169 | 169 |
| 4306 | pVR1012 Gag(delFS)Pol delta PR delta RT delta IN/Nef/h | pVR1012 Gag(delFS)Pol deltaPR deltaRT deltaIN/Nef/h | 170 | 170 |
| 4308 | pVR1012 Gag(delFS)Pol deltaPR deltaRT deltaIN deltaMyr/h | pVR1012 Gag(delFS)Pol deltaPR deltaRT deltaIN delta Myr/h | 171 | 171 |
| 4309 | pVR1012 Gag(delFS)Pol deltaPR deltaRT deltaIN delta Myr/Nef/h | pVR1012x/s Gag(delFS)Pol deltaPR deltaRT deltaIN delta Myr/Nef/h | 172 | 172 |
| 4310 | pVR1012 Nef Gag(del fs)(del Myr)Pol(delta PR delta RT deltaIN)/h | pVR1012 Nef Gag(delFS)(del Myr)Pol(deltaPR deltaRT deltaIN)/h | 173 | 173 |
| 4311 | pVR1012 Gag-C(delFS)Pol(deltaPR deltaRT deltaIN)Nef/h | pVR1012 Gag-C(delPS)Pol(deltaPR daltaRT deltaIN) Nef/h | 174 | 174 |
| 4312 | Gag(delfs)(delMyr)Nef Pol ΔPRΔRTΔIN/h | pVR1012 Gag(delFS)(delMyr)Nef Pol(deltaPR deltaRT deltaIN)/h | 175 | 175 |
| 4313 | VR1012 Gag Clade A(del fs)Pol(ΔPRΔRTΔIN/h | pVR1012 Gag-A(del FS)Pol(delPR delRT delIN)Nef/h | 176 | 176 |

DETAILED DESCRIPTION OF THE PREFERRED EMBODIMENT

The present invention provides modifications of HIV Env, Gag, Pol, and Nef that enhance immunogenicity for genetic immunization. Both HIV and SIV are genetically related members of the lentivirus genus of the Retroviridae family. Lentivirus isolates from humans are grouped into one of two types, designated HIV-1 and HIV-2. A classification scheme recognizes nine subtypes (clades) of HIV-1 (A through 1) and five subtypes of HIV-2 (A through E). A compendium of HIV and SIV sequence information is found in a database prepared by Myers et al., Los Alamos, N. Mex.: Los Alamos National Laboratory.

Nucleic Acid Molecules

As indicated herein, nucleic acid molecules of the present invention may be in the form of RNA or in the form of DNA obtained by cloning or produced synthetically. The DNA may be double-stranded or single-stranded. Single-stranded DNA or RNA may be the coding strand, also known as the sense strand, or it may be the non-coding strand, also referred to as the anti-sense strand.

By "isolated" nucleic acid molecule(s) is intended a nucleic acid molecule, DNA or RNA, which has been removed from its native environment. For example, recombinant DNA molecules contained in a vector are considered isolated for the purposes of the present invention. Further examples of isolated DNA molecules include recombinant DNA molecules maintained in heterologous host cells or purified (partially or substantially) DNA molecules in solution. Isolated RNA molecules include in vivo or in vitro RNA transcripts of the DNA molecules of the present invention. Isolated nucleic acid molecules according to the present invention further include such molecules produced synthetically.

Nucleic acid molecules of the present invention include DNA molecules comprising an open reading frame (ORF) of a wild-type HIV gene; and DNA molecules which comprise a sequence substantially different from those described above but which, due to the degeneracy of the genetic code, still encode an ORF of a wild-type HIV polypeptide. Of course, the genetic code is well known in the art. Degenerate variants optimized for human codon usage are preferred.

In another aspect, the invention provides a nucleic acid molecule comprising a polynucleotide which hybridizes under stringent hybridization conditions to a portion of the polynucleotide in a nucleic acid molecule of the invention described above. By "stringent hybridization conditions" is intended overnight incubation at 42 degree C. in a solution comprising: 50% formamide, 5 times SSC (750 mM NaCl, 75 mM trisodium citrate), sodium phosphate (pH 7.6), 5 times Denhardt's solution, 10% dextran sulfate, and 20 μg/ml denatured, sheared salmon sperm DNA, followed by washing the filters in 0.1 times SSC at about 65 degree C.

By a polynucleotide which hybridizes to a "portion" of a polynucleotide is intended a polynucleotide (either DNA or RNA) hybridizing to at least about 15 nucleotides (nt), and more preferably at least about 20 nt, still more preferably at least about 30 nt, and even more preferably about 30-70 nt of the reference polynucleotide.

By a portion of a polynucleotide of "at least 20 nt in length," for example, is intended 20 or more contiguous nucleotides from the nucleotide sequence of the reference polynucleotide. Of course, a polynucleotide which hybridizes only to a complementary stretch of T (or U) resides, would not be included in a polynucleotide of the invention used to hybridize to a portion of a nucleic acid of the invention, since such a polynucleotide would hybridize to any nucleic acid molecule containing a poly T (or U) stretch or the complement thereof (e.g., practically any double-stranded DNA clone).

As indicated herein, nucleic acid molecules of the present invention which encode an HIV polypeptide may include, but are not limited to those encoding the amino acid sequence of the full-length polypeptide, by itself, the coding sequence for the full-length polypeptide and additional sequences, such as those encoding a leader or secretory sequence, such as a pre-, or pro- or prepro-protein sequence, the coding sequence of the full-length polypeptide, with or without the aforementioned additional coding sequences, together with additional, non-coding sequences, including for example, but not limited to introns and non-coding 5' and 3' sequences, such as the transcribed, non-translated sequences that play a role in transcription, mRNA processing, including splicing and polyadenylation signals, for example, ribosome binding and stability of mRNA; and additional coding sequence which codes for additional amino acids, such as those which provide additional functionalities.

The present invention further relates to variants of the nucleic acid molecules of the present invention, which encode portions, analogs or derivatives of the HIV protein. Variants may occur naturally, such as a natural allelic variant. By an "allelic variant" is intended one of several alternate forms of a gene occupying a given locus on a genome of and organism. Genes 11, Lewin, B., ed., John Wiley & Sons, New York (1985). Non-naturally occurring variants may be produced using art-known mutagenesis techniques.

Such variants include those produced by nucleotide substitutions, deletions or additions, which may involve one or more nucleotides. The variants may be altered in coding regions, non-coding regions, or both. Alterations in the coding regions may produce conservative or non-conservative amino acid substitutions, deletions or additions. Especially preferred among these are silent substitutions, additions and deletions, which do not alter the properties and activities of the HIV polypeptide or portions thereof. Also especially preferred in this regard are conservative substitutions.

Further embodiments of the invention include nucleic acid molecules comprising a polynucleotide having a nucleotide sequence at least 95% identical, and more preferably at least 96%, 97%, 98% or 99% identical to a nucleotide sequence encoding a polypeptide having the amino acid sequence of a wild-type HIV polypeptide or a nucleotide sequence complementary thereto.

By a polynucleotide having a nucleotide sequence at least, for example, 95% "identical" to a reference nucleotide sequence encoding a HIV polypeptide is intended that the nucleotide sequence of the polynucleotide is identical to the reference sequence except that the polynucleotide sequence may include up to five point mutations per each 100 nucleotides of the reference nucleotide sequence encoding the HIV polypeptide. In other words, to obtain a polynucleotide having a nucleotide sequence at least 95% identical to a reference nucleotide sequence, up to 5% of the nucleotides in the reference sequence may be deleted or substituted with another nucleotide, or a number of nucleotides up to 5% of the total nucleotides in the reference sequence may be inserted into the reference sequence. These mutations of the reference sequence may occur at the 5' or 3' terminal positions of the reference nucleotide sequence or anywhere between those terminal positions, interspersed either individually among nucleotides in the reference sequence or in one or more contiguous groups within the reference sequence.

As a practical matter, whether any particular nucleic acid molecule is at least 95%, 96%, 97%, 98% or 99% identical to the reference nucleotide sequence can be determined conventionally using known computer programs such as the Bestfit program (Wisconsin Sequence Analysis Package, Version 8 for Unix, Genetics Computer Group, University Research Park, 575 Science Drive, Madison, Wis. 53711). Bestfit uses the local homology algorithm of Smith and Waterman, Advances in Applied Mathematics 2: 482-489 (1981), to find the best segment of homology between two sequences. When using Bestfit or any other sequence alignment program to determine whether a particular sequence is, for instance, 95% identical to a reference sequence according to the present invention, the parameters are set, of course, such that the percentage of identity is calculated over the full length of the reference nucleotide sequence and that gaps in homology of up to 5% of the total number of nucleotides in the reference sequence are allowed.

The present application is directed to nucleic acid molecules at least 95%, 96%, 97%, 98% or 99% identical to the nucleic acid sequences shown herein in the Sequence Listing which encode a polypeptide having HIV polypeptide activity. By "a polypeptide having HIV activity" is intended polypeptides exhibiting HIV activity in a particular biological assay. For example, Env, Gag, and Pol protein activity can be measured for changes in immunological character by an appropriate immunological assay.

Of course, due to the degeneracy of the genetic code, one of ordinary skill in the art will immediately recognize that a large number of the nucleic acid molecules having a sequence at least 95%, 96%, 97%, 98%, or 99% identical to a nucleic acid sequence shown herein in the Sequence Listing will encode a polypeptide "having HIV polypeptide activity." In fact, since degenerate variants of these nucleotide sequences all encode the same polypeptide, this will be clear to the skilled artisan even without performing the above described comparison assay. It will be further recognized in the art that, for such nucleic acid molecules that are not degenerate variants, a reasonable number will also encode a polypeptide having HIV polypeptide activity. This is because the skilled artisan is fully aware of amino acid substitutions that are either less likely or not likely to significantly effect protein function (e.g., replacing one aliphatic amino acid with a second aliphatic amino acid).

For example, guidance concerning how to make phenotypically silent amino acid substitutions is provided in Bowie, J. U. et al., "Deciphering the Message in Protein Sequences Tolerance to Amino Acid Substitutions," Science 247: 1306-1310 (1990), wherein the authors indicate that proteins are surprisingly tolerant of amino acid substitutions.

Polypeptides and Fragments

The invention further provides a HIV polypeptide having the amino acid sequence encoded by an open reading frame (ORF) of a wild-type HIV gene, or a peptide or polypeptide comprising a portion thereof (e.g., gp120).

It will be recognized in the art that some amino acid sequences of the HIV polypeptides can be varied without significant effect of the structure or function of the protein. If such differences in sequence are contemplated, it should be remembered that there will be critical areas on the protein which determine activity.

Thus, the invention further includes variations of the HIV polypeptide which show substantial HIV polypeptide activity or which include regions of HIV protein such as the protein portions discussed below. Such mutants include deletions, insertions, inversions, repeats, and type substitutions. As indicated, guidance concerning which amino acid changes are likely to be phenotypically silent can be found in Bowie, J. U., et al., "Deciphering the Message in Protein Sequences: Tolerance to Amino Acid Substitutions," Science 247: 1306-1310 (1990).

Thus, the fragment, derivative or analog of the polypeptide of the invention may be (i) one in which one or more of the amino acid residues are substituted with a conserved or non-conserved amino acid residue (preferably a conserved amino acid residue) and such substituted amino acid residue may or may not be one encoded by the genetic code, or (ii) one in which one or more of the amino acid residues includes a substituent group, or (iii) one in which additional amino acids are fused to the mature polypeptide, such as an IgG Fc fusion region peptide or leader or secretory sequence or a sequence which is employed for purification of the mature polypeptide or a proprotein sequence. Such fragments, derivatives and analogs are deemed to be within the scope of those skilled in the art from the teachings herein.

As indicated, changes are preferably of a minor nature, such as conservative amino acid substitutions that do not significantly affect the folding or activity of the protein (see Table A).

TABLE A

| Conservative Amino Acid Substitutions | |
| --- | --- |
| Aromatic | Phenylalanine |
|  | Tryptophan |
|  | Tyrosine |
| Ionizable: Acidic | Aspartic Acid |
|  | Glutamic Acid |
| Ionizable: Basic | Arginine |
|  | Histidine |
|  | Lysine |

TABLE A-continued

| Conservative Amino Acid Substitutions | |
| --- | --- |
| Nonionizable Polar | Asparagine |
|  | Glutamine |
|  | Selenocystine |
|  | Serine |
|  | Threonine |
| Nonpolar (Hydrophobic) | Alanine |
|  | Glycine |
|  | Isoleucine |
|  | Leucine |
|  | Proline |
|  | Valine |
| Sulfur Containing | Cysteine |
|  | Methionine |

Of course, the number of amino acid substitutions a skilled artisan would make depends on many factors, including those described above. Generally speaking, the number of amino acid substitutions for any given HIV polypeptide will not be more than 50, 40, 30, 20, 10, 5 or 3.

Amino acids in the HIV polypeptides of the present invention that are essential for function can be identified by methods known in the art, such as site-directed mutagenesis or alanine-scanning mutagenesis (Cunningham and Wells, Science 244: 1081-1085 (1989)). The latter procedure introduces single alanine mutations at every residue in the molecule. The resulting mutant molecules are then tested for biological activity such as changes in immunological character.

The polypeptides of the present invention are conveniently provided in an isolated form. By "isolated polypeptide" is intended a polypeptide removed from its native environment. Thus, a polypeptide produced and/or contained within a recombinant host cell is considered isolated for purposes of the present invention.

Also intended as an "isolated polypeptide" are polypeptides that have been purified, partially or substantially, from a recombinant host cell or a native source. For example, a recombinantly produced version of the HIV polypeptide can be substantially purified by the one-step method described in Smith and Johnson, Gene 67: 31-40 (1988).

The polypeptides of the present invention include a polypeptide comprising a polypeptide shown herein in the Sequence Listing; as well as polypeptides which are at least 95% identical, and more preferably at least 96%, 97%, 98% or 99% identical to those described above and also include portions of such polypeptides with at least 30 amino acids and more preferably at least 50 amino acids.

By a polypeptide having an amino acid sequence at least, for example, 95% "identical" to a reference amino acid sequence of an HIV polypeptide is intended that the amino acid sequence of the polypeptide is identical to the reference sequence except that the polypeptide sequence may include up to five amino acid alterations per each 100 amino acids of the reference amino acid of the HIV polypeptide. In other words, to obtain a polypeptide having an amino acid sequence at least 95% identical to a reference amino acid sequence, up to 5% of the amino acid residues in the reference sequence may be deleted or substituted with another amino acid, or a number of amino acids up to 5% of the total amino acid residues in the reference sequence may be inserted into the reference sequence. These alterations of the reference sequence may occur at the amino or carboxy terminal positions of the reference amino acid sequence or anywhere between those terminal positions, interspersed either individually among residues in the reference sequence or in one or more contiguous groups within the reference sequence.

As a practical matter, whether any particular polypeptide is at least 95%, 96%, 97%, 98% or 99% identical to, for instance, the amino acid sequence shown herein in the Sequence Listing can be determined conventionally using known computer programs such the Bestfit program (Wisconsin Sequence Analysis Package, Version 8 for Unix, Genetics Computer Group, University Research Park, 575 Science Drive, Madison, Wis. 53711). When using Bestfit or any other sequence alignment program to determine whether a particular sequence is, for instance, 95% identical to a reference sequence according to the present invention, the parameters are set, of course, such that the percentage of identity is calculated over the full length of the reference amino acid sequence and that gaps in homology of up to 5% of the total number of amino acid residues in the reference sequence are allowed.

The polypeptides of the invention may be produced by any conventional means. Houghten, R. A. (1985) General method for the rapid solid-phase synthesis of large numbers of peptides: specificity of antigen-antibody interaction at the level of individual amino acids. Proc. Natl. Acad. Sci. USA 82: 5131-5135. This "Simultaneous Multiple Peptide Synthesis (SMPS)" process is further described in U.S. Pat. No. 4,631, 211 to Houghten et al. (1986).

The present invention also relates to vectors which include the nucleic acid molecules of the present invention, host cells which are genetically engineered with the recombinant vectors, and the production of HIV polypeptides or fragments thereof by recombinant techniques.

The polynucleotides may be joined to a vector containing a selectable marker for propagation in a host. Generally, a plasmid vector is introduced in a precipitate, such as a calcium phosphate precipitate, or in a complex with a charged lipid. If the vector is a virus, it may be packaged in vitro using an appropriate packaging cell line and then transduced into host cells.

The DNA insert should be operatively linked to an appropriate promoter, such as the phage lambda PL promoter, the *E. coli* lac, trp and tac promoters, the SV40 early and late promoters and promoters of retroviral LTRs, to name a few. Other suitable promoters will be known to the skilled artisan. The expression constructs will further contain sites for transcription initiation, termination and, in the transcribed region, a ribosome binding site for translation. The coding portion of the mature transcripts expressed by the constructs will preferably include a translation initiating at the beginning and a termination codon (UAA, UGA or UAG) appropriately positioned at the end of the polypeptide to be translated.

As indicated, the expression vectors will preferably include at least one selectable maker. Such markers include dihydrofolate reductase or neomycin resistance for eukaryotic cell culture and tetracycline or ampicillin resistance genes for culturing in *E. coli* and other bacteria. Representative examples of appropriate hosts include, but are not limited to, bacterial cells, such as *E. coli*, *Streptomyces* and *Salmonella typhimurium* cells; fungal cells, such as yeast cells; insect cells such as *Drosophila* S2 and *Spodoptera* Sf9 cells; animal cells such as CHO, COS and Bowes melanoma cells; and plant cells. Appropriate culture mediums and conditions for the above-described host cells are known in the art.

Among vectors preferred for use in bacteria include pQE70, pQE60 and pQE-9, available from Qiagen; pBS vectors, Phagescript vectors, Bluescript vectors, pNH8A, pNH16a, pNH18A, pNH46A, available from Stratagene; and ptrc99a, pKK223-3, pKK233-3, pDR540, pRIT5 available from Pharmacia. Among preferred eukaryotic vectors are pWLNEO, pSV2CAT, pOG44, pXT1 and pSG available from Stratagene; and pSVK3, pBPV, pMSG and pSVL available from Pharmacia. Other suitable vectors will be readily apparent to the skilled artisan.

Introduction of the construct into the host cell can be effected by calcium phosphate transfection, DEAE-dextran mediated transfection, cationic lipid-mediated transfection, electroporation, transduction, infection or other methods. Such methods are described in many standard laboratory manuals, such as Davis et al., Basic Methods In Molecular Biology (1986).

The HIV polypeptide can be recovered and purified from recombinant cell cultures by well-known methods including ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. Most preferably, high performance liquid chromatography ("HPLC") is employed for purification. Polypeptides of the present invention include naturally purified products, products of chemical synthetic procedures, and products produced by recombinant techniques from a prokaryotic or eukaryotic host, including, for example, bacterial, yeast, higher plant, insect and mammalian cells. Depending upon the host employed in a recombinant production procedure, the polypeptides of the present invention may be glycosylated or may be non-glycosylated. In addition, polypeptides of the invention may also include an initial modified methionine residue, in some cases as a result of host-mediated processes.

Pharmaceutical Formulations, Dosages, and Modes of Administration

The compounds of the invention may be administered using techniques well known to those in the art. Preferably, compounds are formulated and administered by genetic immunization. Techniques for formulation and administration may be found in "Remington's Pharmaceutical Sciences", 18$^{th}$ ed., 1990, Mack Publishing Co., Easton, Pa. Suitable routes may include parenteral delivery, such as intramuscular, intradermal, subcutaneous, intramedullary injections, as well as, intrathecal, direct intraventricular, intravenous, intraperitoneal, intranasal, or intraocular injections, just to name a few. For injection, the compounds of the invention may be formulated in aqueous solutions, preferably in physiologically compatible buffers such as Hanks' solution, Ringer's solution, or physiological saline buffer.

In instances wherein intracellular administration of the compounds of the invention is preferred, techniques well known to those of ordinary skill in the art may be utilized. For example, such compounds may be encapsulated into liposomes, then administered as described above. Liposomes are spherical lipid bilayers with aqueous interiors. All molecules present in an aqueous solution at the time of liposome formation are incorporated into the aqueous interior. The liposomal contents are both protected from the external microenvironment and, because liposomes fuse with cell membranes, are effectively delivered into the cell cytoplasm.

Nucleotide sequences of the invention which are to be intracellularly administered may be expressed in cells of interest, using techniques well known to those of skill in the art. For example, expression vectors derived from viruses such as retroviruses, adenoviruses, adeno-associated viruses, herpes viruses, vaccinia viruses, polio viruses, or sindbis or other RNA viruses, or from plasmids may be used for delivery and expression of such nucleotide sequences into the targeted cell population. Methods for the construction of such expression vectors are well known. See, for example, Sambrook et al., 1989, Molecular Cloning, A Laboratory Manual, Cold Spring Harbor Press, Cold Spring Harbor, N.Y., and Ausubel et al., 1989, Current Protocols In Molecular Biology, Greene Publishing Associates and Wiley Interscience, NY.

The invention extends to the use of a plasmid for primary immunization (priming) of a host and the subsequent use of a recombinant virus, such as a retrovirus, adenovirus, adeno-associated virus, herpes virus, vaccinia virus, polio virus, or sindbis or other RNA virus, for boosting said host, and vice versa. For example, the host may be immunized (primed) with a plasmid by DNA immunization and receive a boost with the corresponding viral construct, and vice versa. Alternatively, the host may be immunized (primed) with a plasmid by DNA immunization and receive a boost with not the corresponding viral construct but a different viral construct, and vice versa.

With respect to HIV Env, Gag, and Pol, protein sequences of the invention may be used as therapeutics or prophylactics (as subunit vaccines) in the treatment of AIDS or HIV infection. A therapeutically effective dose refers to that amount of the compound sufficient to result in amelioration of symptoms or a prolongation of survival in a patient. Toxicity and therapeutic efficacy of such compounds can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compounds which exhibit large therapeutic indices are preferred. The data obtained from cell culture assays and animal studies can be used in formulating a range of dosage for use in humans. The dosage of such compounds lies preferably within a range of circulating concentrations that includes the ED50 with little or no toxicity. The dosage may vary within this range depending upon the dosage form employed and the route of administration utilized. For any compound used in the method of the invention, the therapeutically effective dose can be estimated initially from cell culture assays. A dose may be formulated in animal models to achieve a circulating plasma concentration range that includes the IC50 (e.g., the concentration of the test compound which achieves a half-maximal inhibition of viral infection relative to the amount of the event in the absence of the test compound) as determined in cell culture. Such information can be used to more accurately determine useful doses in humans. Levels in plasma may be measured, for example, by high performance liquid chromatography (HPLC).

The compounds of the invention may, further, serve the role of a prophylactic vaccine, wherein the host produces antibodies and/or CTL responses against HIV Env, Gag and Pol, which responses then preferably serve to neutralize HIV viruses by, for example, inhibiting further HIV infection. Administration of the compounds of the invention as a prophylactic vaccine, therefore, would comprise administering to a host a concentration of compounds effective in raising an immune response which is sufficient to elicit antibody and/or CTL responses to HIV Env, Gag, and Pol, and/or neutralize HIV, by, for example, inhibiting HIV ability to infect cells. The exact concentration will depend upon the specific compound to be administered, but may be determined by using standard techniques for assaying the development of an immune response which are well known to those of ordinary skill in the art.

The compounds may be formulated with a suitable adjuvant in order to enhance the immunological response. Such adjuvants may include, but are not limited to mineral gels such as aluminum hydroxide; surface active substances such as lysolecithin, pluronic polyols, polyanions; other peptides; oil emulsions; and potentially useful human adjuvants such as BCG and *Corynebacterium parvum*.

Adjuvants suitable for co-administration in accordance with the present invention should be ones that are potentially safe, well tolerated and effective in people including QS-21, Detox-PC, MPL-SE, MoGM-CSF, TiterMax-G, CRL-1005, GERBU, TERamide, PSC97B, Adjumer, PG-026, GSK-1, GcMAF, B-alethine, MPC-026, Adjuvax, CpG ODN, Betafectin, Alum, and MF59 (see Kim et al., 2000, Vaccine, 18: 597 and references therein).

Other contemplated adjuvants that may be administered include lectins, growth factors, cytokines and lymphokines such as alpha-interferon, gamma-interferon, platelet derived growth factor (PDGF), gCSF, gMCSF, TNF, epidermal growth factor (EGF), IL-1, IL-2, IL-4, IL-6, IL-8, IL-10 and IL-12.

For all such treatments described above, the exact formulation, route of administration and dosage can be chosen by the individual physician in view of the patient's condition. (See e.g., Fingl et al., 1975, in "The Pharmacological Basis of Therapeutics", Ch. 1 p. 1).

It should be noted that the attending physician would know how to and when to terminate, interrupt, or adjust administration due to toxicity, or to organ dysfunctions. Conversely, the attending physician would also know to adjust treatment to higher levels if the clinical response were not adequate (precluding toxicity). The magnitude of an administered dose in the management of the viral infection of interest will vary with the severity of the condition to be treated and the route of administration. The dose and perhaps prime-boost regimen, will also vary according to the age, weight, and response of the individual patient. A program comparable to that discussed above may be used in veterinary medicine.

The pharmacologically active compounds of this invention can be processed in accordance with conventional methods of galenic pharmacy to produce medicinal agents for administration to patients, e.g., mammals including humans.

The compounds of this invention can be employed in admixture with conventional excipients, i.e., pharmaceutically acceptable organic or inorganic carrier substances suitable for parenteral, enteral (e.g., oral) or topical application which do not deleteriously react with the active compounds. Suitable pharmaceutically acceptable carriers include but are not limited to water, salt solutions, alcohols, gum arabic, vegetable oils, benzyl alcohols, polyethylene glycols, gelatine, carbohydrates such as lactose, amylose or starch, magnesium stearate, talc, silicic acid, viscous paraffin, perfume oil, fatty acid monoglycerides and diglycerides, pentaerythritol fatty acid esters, hydroxy methylcellulose, polyvinyl pyrrolidone, etc. The pharmaceutical preparations can be sterilized and if desired mixed with auxiliary agents, e.g., lubricants, preservatives, stabilizers, wetting agents, emulsifiers, salts for influencing osmotic pressure, buffers, coloring, flavoring and/or aromatic substances and the like which do not deleteriously react with the active compounds. They can also be combined where desired with other active agents, e.g., vitamins.

For parenteral application, which includes intramuscular, intradermal, subcutaneous, intranasal, intracapsular, intraspinal, intrasternal, and intravenous injection, particularly suitable are injectable, sterile solutions, preferably oily or aqueous solutions, as well as suspensions, emulsions, or implants, including suppositories. Formulations for injection may be presented in unit dosage form, e.g., in ampoules or in multi-dose containers, with an added preservative. The compositions may take such forms as suspensions, solutions or emulsions in oily or aqueous vehicles, and may contain formulatory agents such as suspending, stabilizing and/or dispersing agents. Alternatively, the active ingredient may be in powder form for constitution with a suitable vehicle, e.g., sterile pyrogen-free water, before use.

For enteral application, particularly suitable are tablets, dragees, liquids, drops, suppositories, or capsules. The pharmaceutical compositions may be prepared by conventional means with pharmaceutically acceptable excipients such as binding agents (e.g., pregelatinised maize starch, polyvinylpyrrolidone or hydroxypropyl methylcellulose); fillers (e.g., lactose, microcrystalline cellulose or calcium hydrogen phosphate); lubricants (e.g., magnesium stearate, talc or silica); disintegrants (e.g., potato starch or sodium starch glycolate); or wetting agents (e.g., sodium lauryl sulphate). The tablets may be coated by methods well known in the art. Liquid preparations for oral administration may take the form of, for example, solutions, syrups or suspensions, or they may be presented as a dry product for constitution with water or other suitable vehicle before use. Such liquid preparations may be prepared by conventional means with pharmaceutically acceptable additives such as suspending agents (e.g., sorbitol syrup, cellulose derivatives or hydrogenated edible fats); emulsifying agents (e.g., lecithin or acacia); non-aqueous vehicles (e.g., almond oil, oily esters, ethyl alcohol or fractionated vegetable oils); and preservatives (e.g., methyl or propyl-p-hydroxybenzoates or sorbic acid). The preparations may also contain buffer salts, flavoring, coloring and sweetening agents as appropriate. A syrup, elixir, or the like can be used wherein a sweetened vehicle is employed.

Sustained or directed release compositions can be formulated, e.g., liposomes or those wherein the active compound is protected with differentially degradable coatings, e.g., by microencapsulation, multiple coatings, etc. It is also possible to freeze dry the new compounds and use the lyophilizates obtained, for example, for the preparation of products for injection.

For administration by inhalation, the compounds for use according to the present invention are conveniently delivered in the form of an aerosol spray presentation from pressurized packs or a nebulizer, with the use of a suitable propellant, e.g., dichlorodifluoromethane, trichlorofluoromethane, dichlorotetrafluoroethane, carbon dioxide or other suitable gas. In the case of a pressurized aerosol the dosage unit may be determined by providing a valve to deliver a metered amount. Capsules and cartridges of e.g. gelatin for use in an inhaler or insufflator may be formulated containing a powder mix of the compound and a suitable powder base such as lactose or starch.

For topical application, there are employed as non-sprayable forms, viscous to semi-solid or solid forms comprising a carrier compatible with topical application and having a dynamic viscosity preferably greater than water. Suitable formulations include but are not limited to solutions, suspensions, emulsions, creams, ointments, powders, liniments, salves, aerosols, etc., which are, if desired, sterilized or mixed with auxiliary agents, e.g., preservatives, stabilizers, wetting agents, buffers or salts for influencing osmotic pressure, etc. For topical application, also suitable are sprayable aerosol preparations wherein the active ingredient, preferably in combination with a solid or liquid inert carrier material, is packaged in a squeeze bottle or in admixture with a pressurized volatile, normally gaseous propellant, e.g., a freon.

The compositions may, if desired, be presented in a pack or dispenser device which may contain one or more unit dosage forms containing the active ingredient. The pack may for example comprise metal or plastic foil, such as a blister pack. The pack or dispenser device may be accompanied by instructions for administration.

Genetic Immunization

Genetic immunization according to the present invention elicits an effective immune response without the use of infective agents or infective vectors. Vaccination techniques which usually do produce a CTL response do so through the use of an infective agent. A complete, broad based immune response is not generally exhibited in individuals immunized with killed, inactivated or subunit vaccines. The present invention achieves the full complement of immune responses in a safe manner without the risks and problems associated with vaccinations that use infectious agents.

According to the present invention, DNA or RNA that encodes a target protein is introduced into the cells of an individual where it is expressed, thus producing the target protein. The DNA or RNA is linked to regulatory elements necessary for expression in the cells of the individual. Regulatory elements for DNA include a promoter and a polyadenylation signal. In addition, other elements, such as a Kozak region, may also be included in the genetic construct.

The genetic constructs of genetic vaccines comprise a nucleotide sequence that encodes a target protein operably linked to regulatory elements needed for gene expression. Accordingly, incorporation of the DNA or RNA molecule into a living cell results in the expression of the DNA or RNA encoding the target protein and thus, production of the target protein.

When taken up by a cell, the genetic construct which includes the nucleotide sequence encoding the target protein operably linked to the regulatory elements may remain the present in the cell as a functioning extrachromosomal molecule or it may integrate into the cell's chromosomal DNA. DNA may be introduced into cells where it remains as separate genetic material in the form of a plasmid. Alternatively, linear DNA which can integrate into the chromosome may be introduced into the cell. When introducing DNA into the cell, reagents which promote DNA integration into chromosomes may be added. DNA sequences which are useful to promote integration may also be included in the DNA molecule. Since integration into the chromosomal DNA necessarily requires manipulation of the chromosome, it is preferred to maintain the DNA construct as a replicating or non-replicating extrachromosomal molecule. This reduces the risk of damaging the cell by splicing into the chromosome without affecting the effectiveness of the vaccine. Alternatively, RNA may be administered to the cell. It is also contemplated to provide the genetic construct as a linear minichromosome including a centromere, telomeres and an origin of replication.

The necessary elements of a genetic construct of a genetic vaccine include a nucleotide sequence that encodes a target protein and the regulatory elements necessary for expression of that sequence in the cells of the vaccinated individual. The regulatory elements are operably linked to the DNA sequence that encodes the target protein to enable expression.

The molecule that encodes a target protein is a protein-encoding molecule which is translated into protein. Such molecules include DNA or RNA which comprise a nucleotide sequence that encodes the target protein. These molecules may be cDNA, genomic DNA, synthesized DNA or a hybrid thereof or an RNA molecule such as mRNA. Accordingly, as used herein, the terms "DNA construct", "genetic construct" and "nucleotide sequence" are meant to refer to both DNA and RNA molecules.

The regulatory elements necessary for gene expression of a DNA molecule include: a promoter, an initiation codon, a stop codon, and a polyadenylation signal. In addition, enhancers are often required for gene expression. It is necessary that these elements be operable in the vaccinated individual. Moreover, it is necessary that these elements be operably linked to the nucleotide sequence that encodes the target protein such that the nucleotide sequence can be expressed in the cells of a vaccinated individual and thus the target protein can be produced.

Initiation codons and stop codons are generally considered to be part of a nucleotide sequence that encodes the target protein. However, it is necessary that these elements are functional in the vaccinated individual.

Similarly, promoters and polyadenylation signals used must be functional within the cells of the vaccinated individual.

Examples of promoters useful to practice the present invention, especially in the production of a genetic vaccine for humans, include but are not limited to promoters from Simian Virus 40 (SV40), Mouse Mammary Tumor Virus (MMTV) promoter, Human Immunodeficiency Virus (HIV) such as the HIV Long Terminal Repeat (LTR) promoter, Moloney virus, ALV, Cytomegalovirus (CMV) such as the CMV immediate early promoter, Epstein Barr Virus (EBV), Rous Sarcoma Virus (RSV) as well as promoters from human genes such as human Actin, human Myosin, human Hemoglobin, human muscle creatine and human metallothionein.

Examples of polyadenylation signals useful to practice the present invention, especially in the production of a genetic vaccine for humans, include but are not limited to SV40 polyadenylation signals and LTR polyadenylation signals. In particular, the SV40 polyadenylation signal which is in pCEP4 plasmid (Invitrogen, San Diego Calif.), referred to as the SV40 polyadenylation signal, can be used.

In addition to the regulatory elements required for DNA expression, other elements may also be included in the DNA molecule. Such additional elements include enhancers. The enhancer may be selected from the group including but not limited to: human Actin, human Myosin, human Hemoglobin, human muscle creatine and viral enhancers such as those from CMV, RSV and EBV.

Genetic constructs can be provided with mammalian origin of replication in order to maintain the construct extrachromosomally and produce multiple copies of the construct in the cell. Plasmids pCEP4 and pREP4 from Invitrogen (San Diego, Calif.) contain the Epstein Barr virus origin of replication and nuclear antigen EBNA-1 coding region which produces high copy episomal replication without integration.

An additional element may be added which serves as a target for cell destruction if it is desirable to eliminate cells receiving the genetic construct for any reason. A herpes thymidine kinase (tk) gene in an expressible form can be included in the genetic construct. When the construct is introduced into the cell, tk will be produced. The drug gancyclovir can be administered to the individual and that drug will cause the selective killing of any cell producing tk. Thus, a system can be provided which allows for the selective destruction of vaccinated cells.

In order to be a functional genetic construct, the regulatory elements must be operably linked to the nucleotide sequence that encodes the target protein. Accordingly, it is necessary for the initiation and termination codons to be in frame with the coding sequence.

Open reading frames (ORFs) encoding the protein of interest and another or other proteins of interest may be introduced into the cell on the same vector or on different vectors. ORFs on a vector may be controlled by separate promoters or by a single promoter. In the latter arrangement, which gives rise to a polycistronic message, the ORFs will be separated by translational stop and start signals. The presence of an internal ribosome entry site (IRES) site between these ORFs permits the production of the expression product originating from the second ORF of interest, or third, etc. by internal initiation of the translation of the bicistronic or polycistronic mRNA.

According to the invention, the genetic vaccine may be administered directly into the individual to be immunized or ex vivo into removed cells of the individual which are reimplanted after administration. By either route, the genetic material is introduced into cells which are present in the body of the individual. Routes of administration include, but are not limited to, intramuscular, intraperitoneal, intradermal, subcutaneous, intravenous, intraarterially, intraocularly and oral as well as transdermally or by inhalation or suppository. Preferred routes of administration include intramuscular, intraperitoneal, intradermal and subcutaneous injection. Genetic constructs may be administered by means including, but not limited to, traditional syringes, needless injection devices, or microprojectile bombardment gene guns. Alternatively, the genetic vaccine may be introduced by various means into cells that are removed from the individual. Such means include, for example, ex vivo transfection, electroporation, microinjection and microprojectile bombardment. After the genetic construct is taken up by the cells, they are reimplanted into the individual. It is contemplated that otherwise non-immunogenic cells that have genetic constructs incorporated therein can be implanted into the individual even if the vaccinated cells were originally taken from another individual.

The genetic vaccines according to the present invention comprise about 1 nanogram to about 1000 micrograms of DNA. In some preferred embodiments, the vaccines contain about 10 nanograms to about 800 micrograms of DNA. In some preferred embodiments, the vaccines contain about 0.1 to about 500 micrograms of DNA. In some preferred embodiments, the vaccines contain about 1 to about 350 micrograms of DNA. In some preferred embodiments, the vaccines contain about 25 to about 250 micrograms of DNA. In some preferred embodiments, the vaccines contain about 100 micrograms DNA.

The genetic vaccines according to the present invention are formulated according to the mode of administration to be used. One having ordinary skill in the art can readily formulate a genetic vaccine that comprises a genetic construct. In cases where intramuscular injection is the chosen mode of administration, an isotonic formulation is preferably used. Generally, additives for isotonicity can include sodium chloride, dextrose, mannitol, sorbitol and lactose. In some cases, isotonic solutions such as phosphate buffered saline are preferred. Stabilizers include gelatin and albumin. In some embodiments, a vaso-constriction agent is added to the formulation. The pharmaceutical preparations according to the present invention are provided sterile and pyrogen free.

Genetic constructs may optionally be formulated with one or more response enhancing agents such as: compounds which enhance transfection, i.e. transfecting agents; compounds which stimulate cell division, i.e. replication agents; compounds which stimulate immune cell migration to the site of administration, i.e. inflammatory agents; compounds which enhance an immune response, i.e. adjuvants or compounds having two or more of these activities.

In one embodiment, bupivacaine, a well known and commercially available pharmaceutical compound, is administered prior to, simultaneously with or subsequent to the genetic construct. Bupivacaine and the genetic construct may be formulated in the same composition. Bupivacaine is particularly useful as a cell stimulating agent in view of its many properties and activities when administered to tissue. Bupivacaine promotes and facilitates the uptake of genetic material by the cell. As such, it is a transfecting agent. Administration of genetic constructs in conjunction with bupivacaine facilitates entry of the genetic constructs into cells. Bupivacaine is believed to disrupt or otherwise render the cell membrane more permeable. Cell division and replication is stimulated by bupivacaine. Accordingly, bupivacaine acts as a replicating agent. Administration of bupivacaine also irritates and damages the tissue. As such, it acts as an inflammatory agent which elicits migration and chemotaxis of immune cells to the site of administration. In addition to the cells normally present at the site of administration, the cells of the immune system which migrate to the site in response to the inflammatory agent can come into contact with the administered genetic material and the bupivacaine. Bupivacaine, acting as a transfection agent, is available to promote uptake of genetic material by such cells of the immune system as well.

In addition to bupivacaine, mepivacaine, lidocaine, procains, carbocaine, methyl bupivacaine, and other similarly acting compounds may be used as response enhancing agents. Such agents acts a cell stimulating agents which promote the uptake of genetic constructs into the cell and stimulate cell replication as well as initiate an inflammatory response at the site of administration.

Other contemplated response enhancing agents which may function as transfecting agents and/or replicating agents and/or inflammatory agents and which may be administered include lectins, growth factors, cytokines and lymphokines such as alpha-interferon, gamma-interferon, platelet derived growth factor (PDGF), gCSF, gMCSF, TNF, epidermal growth factor (EGF), IL-1, IL-2, IL-4, IL-6, IL-8, IL-10 and IL-12 as well as collagenase, fibroblast growth factor, estrogen, dexamethasone, saponins, surface active agents such as immune-stimulating complexes (ISCOMS), Freund's incomplete adjuvant, LPS analog including monophosphoryl Lipid A (MPL), muramyl peptides, quinone analogs and vesicles such as squalene and squalane, hyaluronic acid and hyaluronidase may also be used administered in conjunction with the genetic construct. In some embodiments, combinations of these agents are co-administered in conjunction with the genetic construct. In other embodiments, genes encoding these agents are included in the same or different genetic construct(s) for co-expression of the agents.

With respect to HIV Env, Gag, and Pol nucleotide sequences of the invention, particularly through genetic immunization, may be used as therapeutics or prophylactics in the treatment of AIDS or HIV infection. A therapeutically effective dose refers to that amount of the compound sufficient to result in amelioration of symptoms or a prolongation of survival in a patient. Toxicity and therapeutic efficacy of such compounds can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compounds which exhibit large therapeutic indices are preferred. The data obtained from cell culture assays and animal studies can be used in formulating a range of dosage for use in humans. The dosage of such compounds lies preferably within a range of circulating concentrations that includes the ED50 with little or no toxicity. The dosage may vary within this range depending upon the dosage form employed and the route of administration utilized. For any compound used in the method of the invention, the therapeutically effective dose can be estimated initially from cell culture assays. A dose may be formulated in animal models to achieve a circulating plasma concentration range that includes the (e.g., the concentration of the test compound which achieves a half-maximal inhibition of viral infection relative to the amount of the event in the absence of the test compound) as determined in cell culture. Such information can be used to more accurately determine useful doses in humans. Levels in plasma may be measured, for example, by high performance liquid chromatography (HPLC).

The compounds (for genetic immunization) of the invention may, further, serve the role of a prophylactic vaccine, wherein the host produces antibodies and/or CTL responses against HIV Env, Gag, and Pol which responses then preferably serve to neutralize HIV viruses by, for example, inhibiting further HIV infection. Administration of the compounds of the invention as a prophylactic vaccine, therefore, would comprise administering to a host a concentration of compounds effective in raising an immune response which is sufficient to elicit antibody and/or CTL responses to HIV Env, Gag, and Pol and/or neutralize HIV, by, for example, inhibiting HIV ability to infect cells. The exact concentration will depend upon the specific compound to be administered, but may be determined by using standard techniques for assaying the development of an immune response which are well known to those of ordinary skill in the art.

Env

To improve the immune response to native gp160 and to expose the core protein for optimal antigen presentation and recognition, we have analyzed the immune response to modified forms of the protein. The role of conserved N-linked glycosylation sites has been studied, and analogues of fusion intermediates have been developed. Expression vectors with deletions in the cleavage site (C), the fusion peptide (F), and the interspace (I) between the two heptad repeats were termed ΔCFI. Plasmid DNA vaccination has been a useful technology for the development and analysis of immunogens. This method of vaccination allows appropriate post-translational modification, proper intracellular trafficking, and antigen presentation. Direct injection of naked DNA either intramuscularly or intradermally in rodents induces immune responses, and the ability to easily modify plasmid expression vectors to express different forms of HIV envelope proteins enables rapid and systematic testing of vaccine immunogens. In this disclosure, we have analyzed the immune response to modified Env candidates expressed in plasmids with modified codons to improve gene expression. Both antibody and CTL responses were analyzed after injection of plasmid DNA into muscle. A modified gp140 DNA with improved ability to elicit antibody and CTL responses to HIV Env has now been identified that is envisioned as a prototype immunogen that can elicit broadly neutralizing antibody responses to HIV.

Exposing the Core Protein of Viral Membrane Fusion Proteins

Described herein are modified HIV envelope proteins that improve the immune response to native gp160 and expose the core protein for optimal antigen presentation and recognition. Weissenhorn et al., Molecular Cell, 2, 605-616, 1998 proposes a core protein as a model for a fusion intermediate of viral glycoproteins, where the glycoproteins are characterized by a central triple stranded coiled coil followed by a disulfide-bonded loop that reverses the chain direction and connects to an α helix packed antiparallel to the core helices, as, for example, in the case of Ebola Zaire GP2, Murine Moloney Leukemia virus (MuMoLv) 55-residue segment of the TM subunit (Mo-55), low-pH-treated influenza HA2, protease resistant core of HIV gp41, and SIV gp41 (FIG. 177). Thus, the strategy for improving the immune response by exposing the protease resistant core of HIV gp41 extends to other viral membrane fusion proteins that are characterized by a central stranded coiled coil followed by a disulfide-bonded loop that reverses the chain direction connects to an α helix packed antiparallel to the core helices.

The present approach involves a series of internal mutations designed to replace the cleavage site (C), the fusion domain (F), and the interspace (I) between the two heptad repeats all on a backbone of COOH-terminal truncations to expose the core protein of the viral membrane fusion protein Env, based on modified gp140 as a prototype immunogen. By replacement is meant deletions, insertions, and/or substitutions of amino acid residues. In one embodiment, deletions are meant (i.e., amino acids are deleted to create the ΔCFI mutations).

In this embodiment, the AC mutation is intended to eliminate proteolysis by deleting gp120/gp41 cleavage site that links the envelope covalently to the ectodomain by 100%, 99%, 98%, 97%, 96%, 95%, 94%, 93%, 92%, 91%, 90%, 89%, 88%, 87%, 86%, 85%, 84%, 83%, 82%, 81,%, 80%, 79%, 78%, 77%, 76%, 75%, 74%, 73,%, 72%, 71%, 70%, 69%, 68%, 67%, 66%, 65%, 64%, 63%, 62%, 61%, 60%, 59%, 58%, 57%, 56%, 55%, 54%, 53%, 52%, 51%, 50%, 49%, 48%, 47%, 46%, 45%, 44%, 43%, 42, 41%, 40%, 39%, 38%, 37%, 36%, 35%, 34%, 33%, 32%, 31%, 30%, 29%, 28%, 27%, 26%, 25%, 24%, 23%, 22%, 21%, 20%, 19%, 18%, 17%, 16%, 15%, 14%, 13%, 12%, 11%, 10%, 9%, 8%, 7%, 6%, 5%, 4%, 3%, 2%, or 1%.

In this embodiment, the AF mutation is intended to solubilize the molecule by deleting the fusion domain by 100%, 99%, 98%, 97%, 96%, 95%, 94%, 93%, 92%, 91%, 90%, 89%, 88%, 87%, 86%, 85%, 84%, 83%, 82%, 81,%, 80%, 79%, 78%, 77%, 76%, 75%, 74%, 73%, 72%, 71%, 70%, 69%, 68%, 67%, 66%, 65%, 64%, 63%, 62%, 61%, 60%, 59%, 58%, 57%, 56%, 55%, 54%, 53%, 52%, 51%, 50%, 49%, 48%, 47%, 46%, 45%, 44%, 43%, 42%, 41%, 40%, 39%, 38%, 37%, 36%, 35%, 34%, 33%, 32%, 31%, 30%, 29%, 28%, 27%, 26%, 25%, 24%, 23%, 22%, 21%, 20%, 19%, 18%, 17%, 16%, 15%, 14%, 13%, 12%, 11%, 10%, 9%, 8%, 7%, 6%, 5%, 4%, 3%, 2%, or 1%.

In this embodiment, the ΔI mutation is intended to stabilize oligomer formation by deleting the interspace between the two heptad repeats by 100%, 99%, 98%, 97%, 96%, 95%, 94%, 93%, 92%, 91%, 90%, 89%, 88%, 87%, 86%, 85%, 84%, 83%, 82%, 81%, 80%, 79%, 78%, 77%, 76%, 75%, 74%, 73,%, 72%, 71%, 70%, 69%, 68%, 67%, 66%, 65%, 64%, 63%, 62%, 61%, 60%, 59%, 58%, 57%, 56%, 55%, 54%, 53%, 52%, 51%, 50%, 49%, 48%, 47%, 46%, 45%, 44%, 43%, 42, 41%, 40%, 39%, 38%, 37%, 36%, 35%, 34%, 33%, 32%, 31%, 30%, 29%, 28%, 27%, 26%, 25%, 24%, 23%, 22%, 21%, 20%, 19%, 18%, 17%, 16%, 15%, 14%, 13%, 12%, 11%, 10%, 9%, 8%, 7%, 6%, 5%, 4%, 3%, 2%, or 1%.

In this embodiment, the COOH-terminal truncation is intended to reduce toxicity by deleting the cytoplasmic domain by 100%, 99%, 98%, 97%, 96%, 95%, 94%, 93%, 92%, 91%, 90%, 89%, 88%, 87%, 86%, 85%, 84%, 83%, 82%, 81,%, 80%, 79%, 78%, 77%, 76%, 75%, 74%, 73,%, 72%, 71%, 70%, 69%, 68%, 67%, 66%, 65%, 64%, 63%, 62%, 61%, 60%, 59%, 58%, 57%, 56%, 55%, 54%, 53%, 52%, 51%, 50%, 49%, 48%, 47%, 46%, 45%, 44%, 43%, 42, 41%, 40%, 39%, 38%, 37%, 36%, 35%, 34%, 33%, 32%, 31%, 30%, 29%, 28%, 27%, 26%, 25%, 24%, 23%, 22%, 21%, 20%, 19%, 18%, 17%, 16%, 15%, 14%, 13%, 12%, 11%, 10%, 9%, 8%, 7%, 6%, 5%, 4%, 3%, 2%, or 1%.

In this embodiment, optionally, the COOH-terminal truncation is extended so as to solubilize the molecule by deleting the transmembrane domain by 100% 99%, 98%, 97%, 96%, 95%, 94%, 93%, 92%, 91%, 90%, 89%, 88%, 87%, 86%, 85%, 84%, 83%, 82%, 81,%, 80%, 79%, 78%, 77%, 76%, 75%, 74%, 73,%, 72%, 71%, 70%, 69%, 68%, 67%, 66%, 65%, 64%, 63%, 62%, 61%, 60%, 59%, 58%, 57%, 56%, 55%, 54%, 53%, 52%, 51%, 50%, 49%, 48%, 47%, 46%, 45%, 44%, 43%, 42, 41%, 40%, 39%, 38%, 37%, 36%, 35%, 34%, 33%, 32%, 31%, 30%, 29%, 28%, 27%, 26%, 25%, 24%, 23%, 22%, 21%, 20%, 19%, 18%, 17%, 16%, 15%, 14%, 13%, 12%, 11%, 10%, 9%, 8%, 7%, 6%, 5%, 4%, 3%, 2%, or 1%.

Amino acid substitutions may encompass those of a conserved or non-conserved nature. Presumably, a non-conserved substitution of a domain would act like a deletion of the domain. Conserved amino acid substitutions constitute switching one or more amino acids with amino acids of similar charge, size, and/or hydrophobicity characteristics. Non-conserved amino acid substitutions constitute switching one or more amino acids with amino acids of dissimilar charge, size, and/or hydrophobicity characteristics. The families of amino acids include the basic amino acids (lysine, arginine, histidine); the acidic amino acids (aspartic acid, glutamic acid); the non-polar amino acids (alanine, valine, leucine, isoleucine, proline, phenylalanine, methionine, tryptophan); the uncharged polar amino acids (glycine, asparagine, glutamine, cysteine, serine, threonine, tyrosine); and the aromatic amino acids (phenylalanine, tryptophan, and tyrosine). One or more substitutions may be introduced to achieve the ΔC mutation intended to eliminate proteolysis by acting like a deletion of the gp120/gp41 cleavage site to link the envelope covalently to the ectodomain, the ΔF mutation intended to solubilize the molecule by acting like a deletion of the fusion domain, the ΔI mutation intended to stabilize oligomer formation by acting like a deletion of the interspace between the two heptad repeats, the COOH-terminal truncation intended to reduce toxicity by acting like a deletion of the cytoplasmic domain, and, optionally, the COOH-terminal truncation extended so as to solubilize the molecule by acting like a deletion of the transmembrane domain.

Amino acid insertions may constitute single amino acid residues or stretches of residues. The insertions may be made at the carboxy or amino terminal end of a domain, as well as at a position internal to the domain. Such insertions will generally range from 2 to 15 amino acids in length. One or more insertions may be introduced to achieve the ΔC mutation intended to eliminate proteolysis by acting like a deletion of the gp120/gp41 cleavage site to link the envelope covalently to the ectodomain, the ΔF mutation intended to solubilize the molecule by acting like a deletion of the fusion domain, the ΔI mutation intended to stabilize oligomer formation by acting like a deletion the interspace between the two heptad repeats, the COOH-terminal truncation intended to reduce toxicity by acting like a deletion of the cytoplasmic domain, and, optionally, the COOH-terminal truncation extended so as to solubilize the molecule by acting like a deletion of the transmembrane domain.

The nucleic acids of the present invention are optionally DNA, RNA, or mRNA. Most typically, the nucleic acids are provided by recombinantly making a DNA, which is expressed in a cell as RNA and/or as mRNA. Given the strategy for making the nucleic acids of the present invention, one of skill can construct a variety of clones containing functionally equivalent nucleic acids. Cloning methodologies to accomplish these ends, and sequencing methods to verify the sequence of nucleic acids are well known in the art. Examples of appropriate cloning and sequencing techniques, and instructions sufficient to direct persons of skill through many cloning exercises are found in Berger and Kimmel, Guide to Molecular Cloning Techniques, Methods in Enzymology, volume 152, Academic Press, Inc., San Diego, Calif. (Berger); Sambrook, et al. (1989) Molecular Cloning—A Laboratory Manual (2nd ed.) Vol. 1-3, Cold Spring Harbor Laboratory, Cold Spring Harbor Press, N.Y., (Sambrook); and Current Protocols in Molecular Biology, F. M. Ausubel, et al., eds., Current Protocols, a joint venture between Greene Publishing Associates, Inc. and John Wiley & Sons, Inc., (1994 Supplement) (Ausubel). Product information from manufacturers of biological reagents and experimental equipment also provide information useful in known biological methods. Such manufacturers include the SIGMA chemical company (Saint Louis, Mo.), R&D systems (Minneapolis, Minn.), Pharmacia LKB Biotechnology (Piscataway, N.J.), CLONTECH Laboratories, Inc. (Palo Alto, Calif.), Chem Genes Corp., Aldrich Chemical Company (Milwaukee, Wis.), Glen Research, Inc., GIBCO BRL Life Technologies, Inc. (Gaithersburg, Md.), Fluka Chemica-Biochemika Analytika (Fluka Chemie A G, Buchs, Switzerland), Invitrogen, San Diego, Calif., and Applied Biosystems (Foster City, Calif.), as well as many other commercial sources known to one of skill.

The nucleic acid compositions of this invention, whether RNA, cDNA, mRNA, genomic DNA, or a hybrid of the various combinations, are isolated from biological sources or synthesized in vitro. The nucleic acids of the present invention are present in transformed or transfected whole cells, in transformed or transfected cell lysates, or in a partially purified or substantially pure form.

In vitro amplification techniques suitable for amplifying sequences to provide a nucleic acid or for subsequent analysis, sequencing or subcloning are known. Examples of techniques sufficient to direct persons of skill through in vitro amplification methods, including the polymerase chain reaction (PCR) the ligase chain reaction (LCR), Qβ-replicase amplification and other RNA polymerase mediated techniques (e.g., NASBA) are found in Berger, Sambrook, and Ausubel, as well as Mullis, et al., (1987) U.S. Pat. No. 4,683, 202; PCR Protocols A Guide to Methods and Applications (Innis, et al. eds) Academic Press Inc. San Diego, Calif. (1990) (Innis); Arnheim & Levinson (Oct. 1, 1990) C&EN 36-47; The Journal Of NIH Research (1991) 3: 81-94; Kwoh, et al., Proc. Natl. Acad. Sci. USA, 86: 1173 (1989); Guatelli, et al., Proc. Natl. Acad. Sci. USA, 87: 1874 (1990); Lomell, et al., J. Clin. Chem., 35: 1826 (1989); Landegren, et al., Science, 241: 1077-1080 (1988); Van Brunt, Biotechnology, 8: 291-294 (1990); Wu and Wallace, Gene, 4: 560 (1989); Barringer, et al., Gene, 89: 117 (1990), and Sooknanan and Malek, Biotechnology, 13: 563-564 (1995). Improved methods of cloning in vitro amplified nucleic acids are described in Wallace, et al., U.S. Pat. No. 5,426,039. Improved methods of amplifying large nucleic acids (up to 40 kb) are summarized in Cheng, et al., Nature, 369: 684-685 (1994) and the references therein. One of skill will appreciate that essentially any RNA can be converted into a double stranded DNA suitable for restriction digestion, PCR expansion and sequencing using reverse transcriptase and a polymerase. See, Ausubel, Sambrook, Innis, and Berger, all supra.

One of skill will recognize many ways of generating alterations in a given nucleic acid construct. Such well-known methods include site-directed mutagenesis, PCR amplification using degenerate oligonucleotides, exposure of cells containing the nucleic acid to mutagenic agents or radiation, chemical synthesis of a desired oligonucleotide (e.g., in conjunction with ligation and/or cloning to generate large nucleic acids) and other well-known techniques. See, Giliman and Smith, Gene 8: 81-97 (1979), Roberts, et al., Nature, 328: 731-734 (1987) and Sambrook, Innis, Ausubel, Berger, and Mullis (all supra).

Most modifications to nucleic acids are evaluated by routine screening techniques in suitable assays for the desired characteristic. For instance, changes in the immunological character of encoded polypeptides can be detected by an appropriate immunological assay. For instance, changes in the cellular immunological character of the polypeptide can be detected by an appropriate antibody or CTL assay. Modifications of other properties such as nucleic acid hybridization to a complementary nucleic acid, redox or thermal stability of encoded proteins, hydrophobicity, susceptibility to proteolysis, or the tendency to aggregate are all assayed according to standard techniques.

A wide variety of formats and labels are available and appropriate for detection of polypeptide sequences. These include analytic biochemical methods such as spectrophotometry, radiography, electrophoresis, capillary electrophoresis, high performance liquid chromatography (HPLC), thin layer chromatography (TLC), hyperdiffusion chromatography, and the like, and various immunological methods such as fluid or gel precipitin reactions, immunodiffusion (single or double), immunoelectrophoresis, radioimmunoassays (RIAs), enzyme-linked immunosorbent assays (ELISAs), western blot assays, immunofluorescent assays, and the like. Several commercially available ELISA assays for the detection of retroviral components, including Env domains, are available, allowing one of skill to detect Env in biological samples.

Similarly, the detection of the nucleic acids of the present invention proceeds by well known methods such as Southern analysis, northern analysis, gel electrophoresis, PCR, radiolabeling and scintillation counting, and affinity chromatography. Many assay formats are appropriate, including those reviewed in Tijssen (1993) Laboratory Techniques in biochemistry and molecular biology—hybridization with nucleic acid probes parts I and II, Elsevier, New York and Choo (ed) (1994) Methods In Molecular Biology Volume 33—In Situ Hybridization Protocols, Humana Press Inc., New Jersey (see also, other books in the Methods in Molecular Biology series); see especially, Chapter 21 of Choo (id.) "Detection of Virus Nucleic Acids by Radioactive and Nonisotopic in Situ Hybridization". Finally, PCR is also routinely used to detect nucleic acids in biological samples (see, Innis, supra, for a general description of PCR techniques).

In one preferred embodiment, antibodies are used to detect polypeptide sequences. Methods of producing polyclonal and monoclonal antibodies are known to those of skill in the art, and many anti-HIV antibodies are available. See, e.g., Coligan (1991) Current Protocols in Immunology, Wiley/Greene, NY; and Harlow and Lane (1989) Antibodies: A Laboratory Manual, Cold Spring Harbor Press, NY; Stites, et al. (eds.) Basic and Clinical Immunology (4th ed.), Lange Medical Publications, Los Altos, Calif., and references cited therein; Goding (1986) Monoclonal Antibodies: Principles and Practice (2d ed.), Academic Press, New York, N.Y.; and Kohler and Milstein, Nature, 256: 495-497 (1975). Other suitable techniques for antibody preparation include selection of libraries of recombinant antibodies in phage or similar vectors. See, Huse, et al., Science, 246: 1275-1281 (1989); and Ward, et al., Nature, 341: 544-546 (1989). Specific monoclonal and polyclonal antibodies and antisera will usually bind with a KD of at least about 0.1 mM, more usually at least about 1 μM, preferably at least about 0.1 μM or better, and most typically and preferably, 0.01 μM or better.

Development of HIV Env Vectors

Figure 178A:
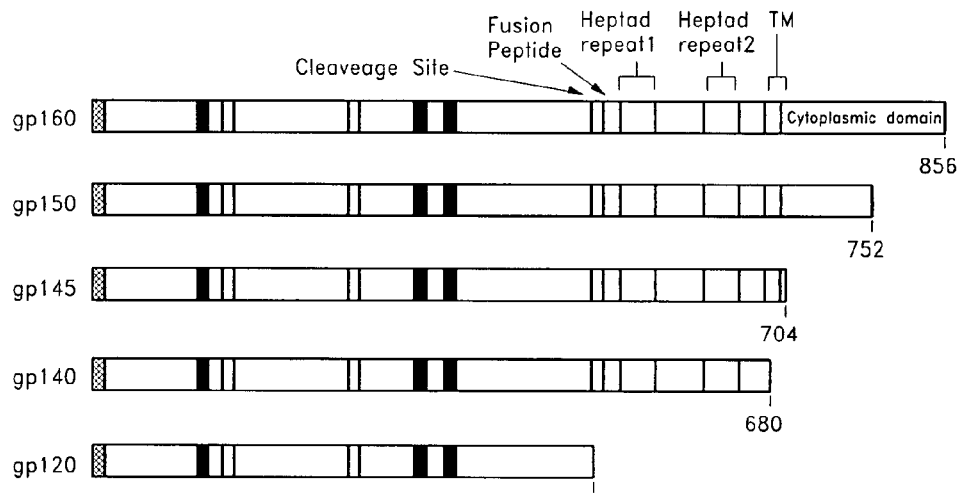
FIG. 178. Schematic representation of functional domains and mutations in HIV-1 Env glycoproteins. Full-length envelope polyprotein, gp160, with the indicated features based on the amino acid residues of HXB2 is shown (top). Functional domains include the gp120/gp41/ cleavage site (residues 510/511), the fusion domain (512-527), the two heptad repeats (546-579 and 628-655), the transmembrane domain (684-705), and the cytoplasmic domain (706-856). The mutant forms of the envelope proteins are shown below the structure of gp160. COOH deletions were introduced that terminate the envelope protein at positions 752, 704, or 680 to produce gp150, gp145, or gp140, respectively. Two internal deletions that removed the cleavage site, the fusion domain, and the region between the two heptad repeats were introduced into gp160, gp150, gp145, and gp140. A further deletion in the COOH-terminal region at position 592 removed the second heptad repeat, the transmembrane domain, and the interspace region to produce gp128ΔCFI. To disrupt potential glycosylation sites, asparagine (N) residues at eleven positions (88, 156, 160, 197, 230, 234, 241, 262, 276, 289, and 295) were replaced with aspartic acid (D) residues in both gp160 and gp150. Versions of both gp160 and gp150 were created with a total of 17 mutated glycosylation sites by including six additional N to D substitutions at positions 332, 339, 356, 386, 392, and 448.
Figure 178B:
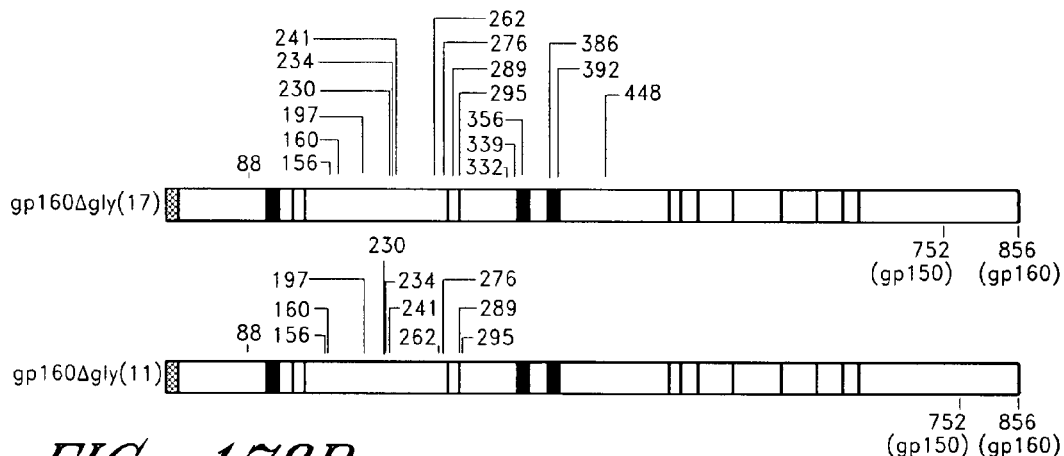
Figure 178C:
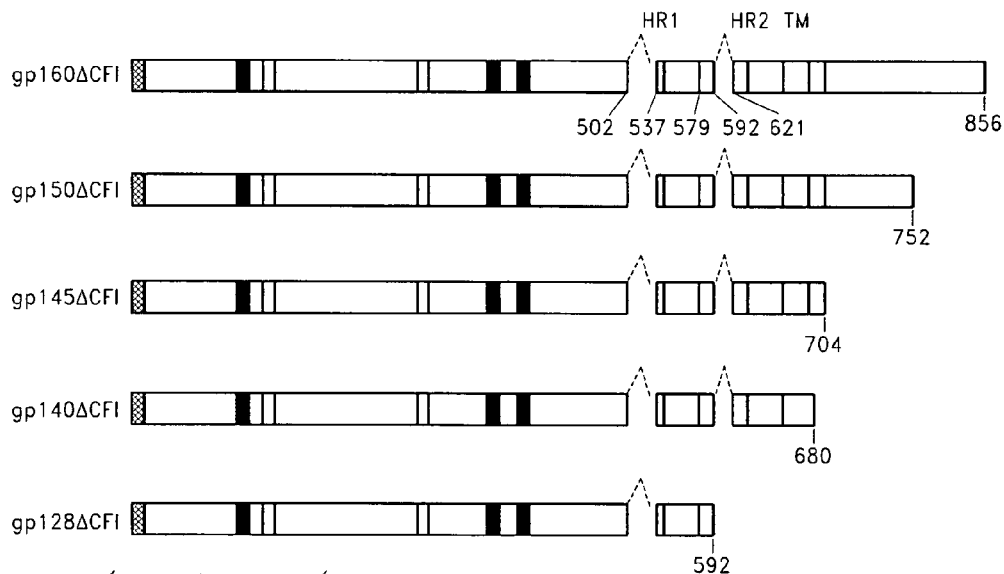
Figures 179A, 179B, 179C, 179D:
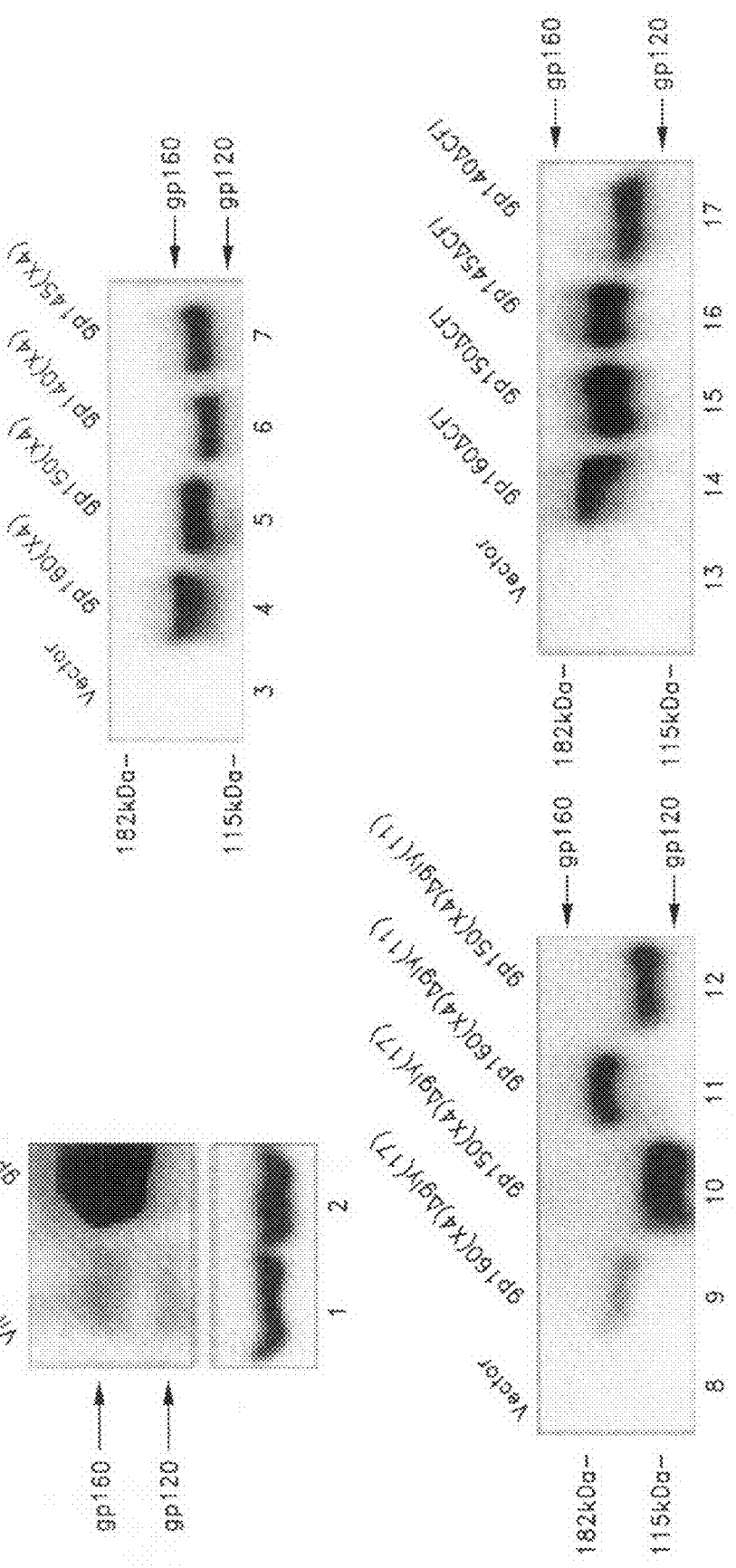
FIG. 179. Comparison of the expression of the HIV-1 gp160 with codon-optimized gp160. A. Expression of plasmids encoding Rev-dependent and Rev-independent codon-modified gp160. Upper panel: expression of Rev-dependent viral gp160 (left) and codon-modified gp160 (right) in transfected 293 cells. Lower panel: comparable expression of β-actin in these transfected cells. B. Expression of mutant CXCR4-tropic HIV Env glycoproteins with COOH-terminal truncations. C and D, respectively. CXCR4-tropic envelope proteins containing mutant glycosylation sites and mutant functional domains. The indicated proteins were detected by immunoblotting as above. Cell lysates produced by transfection with vector containing no insert were used as controls (first lane in each panel).
Figure 180B:
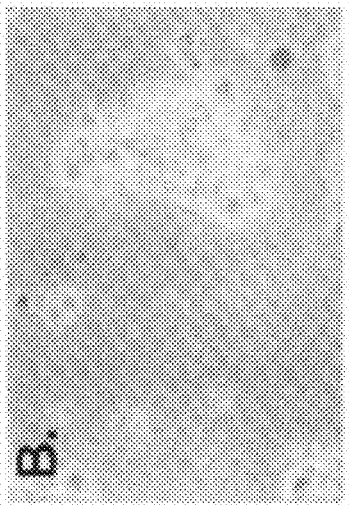
FIG. 180. Cytotoxicity of full-length gp160 is eliminated by deletion of the COOH-terminal cytoplasmic domain. Cell rounding and detachment was not observed in control-transfected 293 cells (A), in contrast to full-length gp160 (B) and to a lesser extent in cells transfected with gp150 (C), in contrast to gp145 (D) or gp140 (E).
Figure 180A:
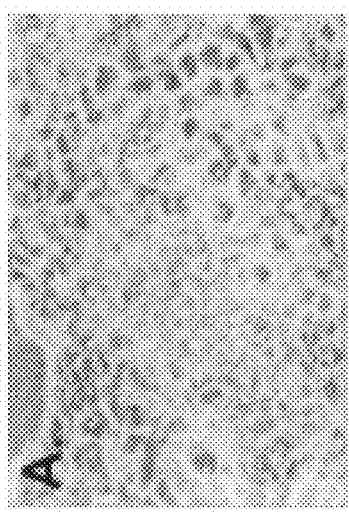
Figure 180E:
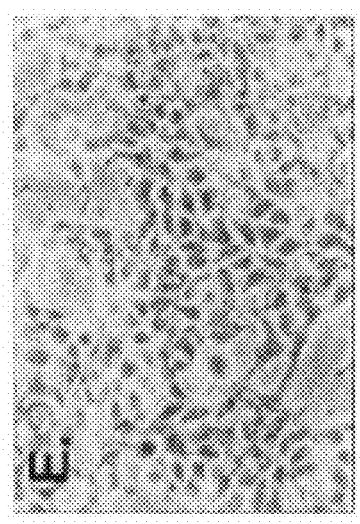
Figure 180D:
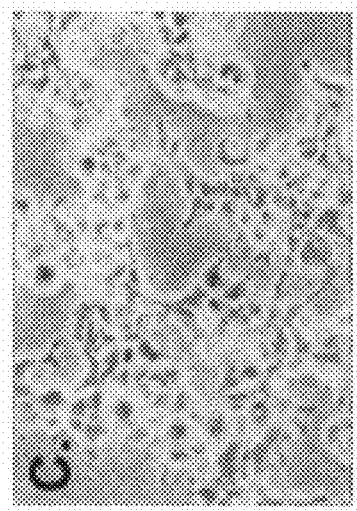
Figure 180C:
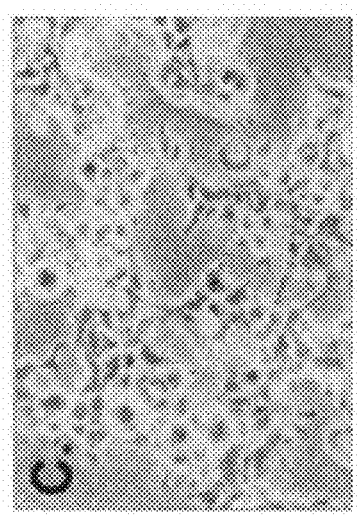

To develop Env glycoprotein variants that might effectively induce humoral and cellular immunity, a series of plasmid expression vectors were generated (FIG. 178). HIV Env is encoded by nucleic acid sequences that contain RNA structures that limit gene expression. These vectors were therefore synthesized using codons found in human genes that allow these structures to be eliminated without affecting the amino acid sequence. Full-length HIV Env (gp160) was highly expressed in the absence of HIV accessory proteins at levels ≧10-fold higher than Rev-dependent viral gp160 in transfected 293 cell by Western blot analysis (FIG. 179A), and the relevant mutant proteins were detected at the expected apparent molecular weights (FIGS. 179B-D). As might be anticipated, gp160 expressed from the synthetic gene was not efficiently processed in transfected 293 cells, presumably because over-expression of gp160 saturates the cellular proteases responsible for cleavage. (Binley J M et al., 2000, J. Virol, 74: 627-643.) Synthetic HIV gp160 induced toxicity in transfected cells, with cell rounding and detachment evident within 48 hours (FIG. 180A vs B). This cytotoxicity was reduced by elimination of the COOH-terminal cytoplasmic domain. Env protein that terminated at amino acid 752 (gp150) was less cytotoxic than gp160, while the shorter proteins (gp145 and gp140) produced little or no effect (FIGS. 180C, D, and E, respectively).

To alter Env immunogenicity, two different approaches were explored. First the effects of glycosylation on cellular and humoral immunity were evaluated by analysis of mutants in which conserved N-linked glycosylation sites were eliminated by site-directed mutagenesis. Two sets of mutations were introduced into both gp160 and gp150 (FIG. 178). The first set included eleven potential sites (Δgly11), and the second set included an additional 6 sites downstream (Δgly17). Expression studies showed that the glycosylation mutants were efficiently expressed, and the glycosylation mutant protein was appropriately reduced in size compared to wild type gp160 or gp150, consistent with reduced N-linked glycosylation (FIG. 179C).

The second approach involved a series of internal deletions designed to stabilize and expose functional domains of the protein that might be present in an extended helical structure prior to the formation of the six-member coiled-coil structure in the hairpin intermediate. To generate this putative pre-hairpin structure, the cleavage site was removed to prevent the proteolytic processing of the envelope and stabilize the protein by linking it covalently to the gp41 extracellular and/or transmembrane domain. To reduce toxicity and enhance stability, the fusion peptide domain was deleted. The heptad repeats in the envelope protein are important tertiary structure domains involved in the ability of the envelope protein to form trimers. The sequence between the heptad repeats was removed to stabilize the formation of trimers and eliminate formation of the hairpin intermediate. These ΔCFI deletions were introduced into full-length gp160 and COOH-terminal truncation mutants. Though cells transfected with vectors encoding gp140ΔCFI, gp145ΔCFI and gp160 readily expressed these proteins (FIG. 179D), only gp140ΔCFI, which lacks the transmembrane domain, was readily detected in the supernatant (FIG. 181), indicating that it can give rise to soluble antigen.

Immunogenicity of Env Mutants After DNA Vaccination

The ability of these Env proteins to elicit an immune response was determined in mice by injection with these plasmid DNA expression vectors. Antibody responses were monitored by the ability of antisera from injected mice to immunoprecipitate wild type gp160 from cell lysates by SDS-PAGE and Western blotting (FIG. 182). In some cases, antibody reactivity was also confirmed by immunofluorescence. To quantitate the antibody response, immunoprecipitation followed by Western blotting with different dilutions of immunized mouse sera was tested. The intensity of the gp160 band was determined by densitometry and standardized relative to a positive control sera used to normalize data between experiments. The approximately linear dose response of gp160 intensity with serum dilution allowed quantification of the anti-gp160 antibody response in mouse sera. Data from immunized mice showed that none of the wild type Env proteins, neither the gp160, gp150, gp145, nor gp140 COOH-terminal truncations generated consistently high antibody responses (FIG. 182A). Of these proteins, gp140 was somewhat more effective than gp160 in generating antibody responses but remained low and inconsistent. Immunization with vectors designed to express glycosylation deficient envelope proteins also did not improve the humoral response. In contrast, the ΔCFI mutants in the Env truncation vectors substantially increased anti-gp160 antibody response (FIG. 182A; gp145, gp140, and gp128). The longer ΔCFI Env proteins (gp160 and gp150) did not show comparable enhancement of this response. The gp140 (ΔCFI) provided more consistent and a greater increase in antibody response than gp128ΔCFI (FIG. 182B). In all cases, these vectors that encoded gp140ΔCFI, but not wild type gp140, induced antibodies that were reactive to native gp160 (FIG. 182C).

To determine whether these modifications of Env adversely affected CTL responses, spleen cells from immunized mice were tested for their ability to lyse relevant target cells. All mice immunized with codon-altered Env vectors, including COOH-terminal deletion mutations (FIG. 183A) or glycosylation mutants (FIG. 183C), elicited strong CTL responses directed to cell lines pulsed with HIV Env peptides. These findings were also confirmed using stably transfected cells that expressed Env. Importantly, gp140 (ΔCFI), which elicited increased antibody responses relative to the comparable wild type Env, readily induced CTL responses to native Env, as did other ΔCFI mutants (FIG. 183D). Addition of anti-CD8 antibody inhibited cytolytic activity, as did depletion using magnetic beads coupled with anti-CD8 antibody, thus confirming a cytotoxic T cell response to these immunogens after genetic immunization (FIG. 183B). This response was detectable for at least six months after immunization.

Glycosylation and ΔCFI HIV Env Mutants

To develop DNA vaccine candidates for HIV, we developed a series of synthetic genes designed to express HIV Env mutants in human cells. In the absence of HIV regulatory proteins, these codon-altered envelope protein genes expressed well in human cells. Like other DNA vaccines, immunization with these vectors elicited strong CTL responses in mice, and antibody responses were not robust in mice immunized with wild type Env expression vectors. Mutations in highly conserved N-linked glycosylation sites did not significantly alter humoral or cellular immune response to native Env. In contrast, a mutant Env with deletions in the cleavage site, fusion domain, and a region between the heptad repeats elicited a more potent humoral immune response and retained its ability to stimulate Env-specific CTL.

Figure 181:
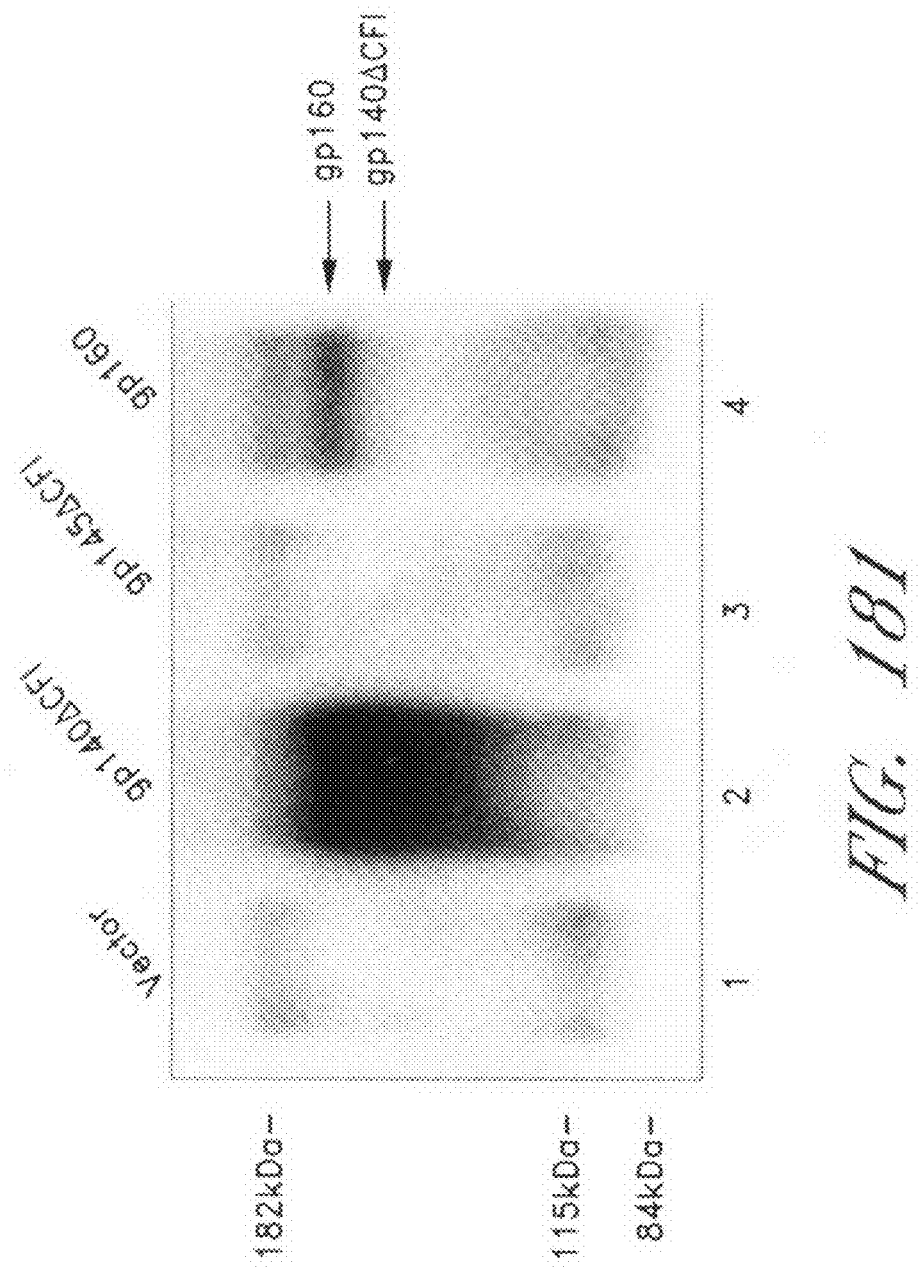
FIG. 181. Expression of soluble gp140ΔCFI HIV-1 envelope variant. Immunoprecipitation and Western blot analysis of supernatants from the indicated transfected cells.
Figure 182A:
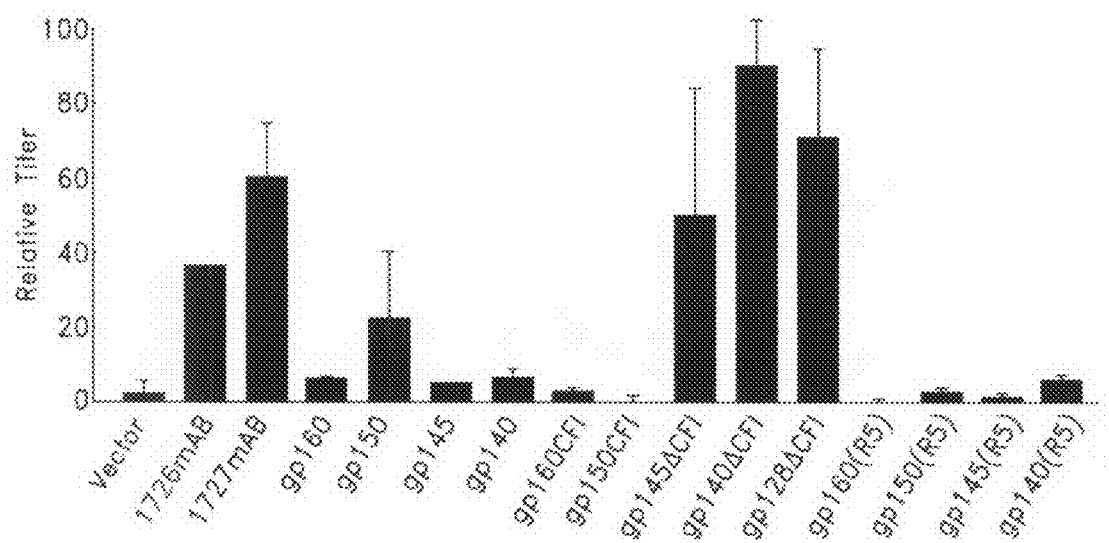
FIG. 182. Antibody response against HIV-1 envelope proteins in DNA immunized mice. A. Comparison of the antibody response in mice immunized with gp140 (ΔCFI) or other Env plasmid expression vectors. Sera were collected 2 weeks after the last immunization and used to immunoprecipitate codon-altered gp160 from lysates of transfected 293 cells. The quantitation of the immunoprecipitated gp160 was done as described in FIG. 182B. The average of the normalized data has been presented as a bar diagram. B. Antibody responses in mice immunized with different mutant Env expression vectors. Antisera from immunized mice were diluted in IP buffer and 1 µl of each diluted serum was used to immunoprecipitate codon-altered HIV-1 gp160 from lysates of transfected 293 cells as described in FIG. 180A. The gels were scanned and the intensity of the gp160 band was determined by densitometry using the program Image Quant and presented relative to the intensity of gp160 immunoprecipitated with positive control sera (rabbit anti-gp160), which was used to normalize data between experiments. These data are presented graphically to facilitate comparison among groups. C. Antibody responses in mice immunized with gp140 or gp140 (ΔCFI) were determined by immunoprecipitation and Western blotting. Animals received two booster doses (100 µg) of the same plasmid, two weeks apart. Sera (1 µl) collected 2 weeks after the last immunization was used to immunoprecipitate codon-optimized HIV-1 gp160 from lysates of transfected 293 cells containing 400 µg of total protein. Each lane corresponds to the sera from an animal immunized with either the control vector (lanes 1 and 2), CXCR4-tropic gp140 (lanes 3-6), or plasmid that expresses gp140 with the indicated mutant functional domains (lanes 7-10). A mouse monoclonal antibody to gp160 (HIV-1 V3 Monoclonal (IIIB-V3-13), NIH AIDS Reagent Program) was used as a positive control (lane 11).
Figure 182B:
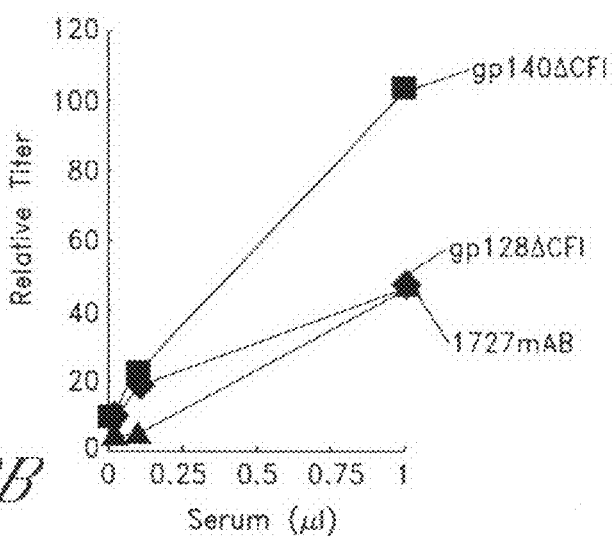
Figure 182C:
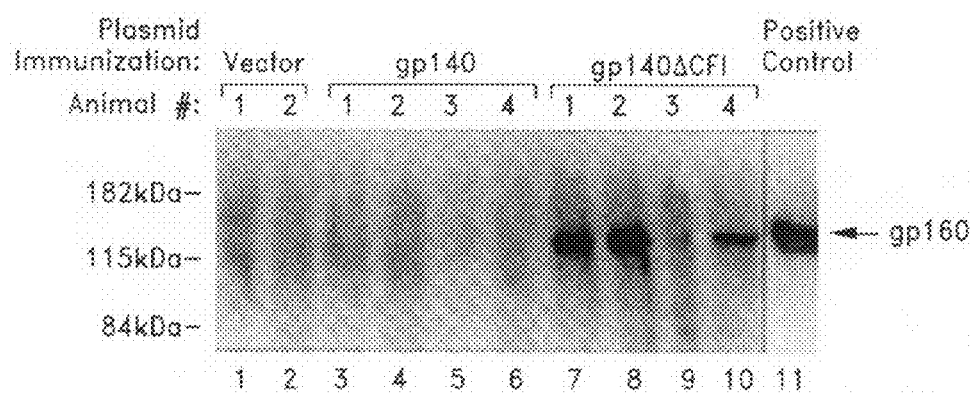
Figure 183A:
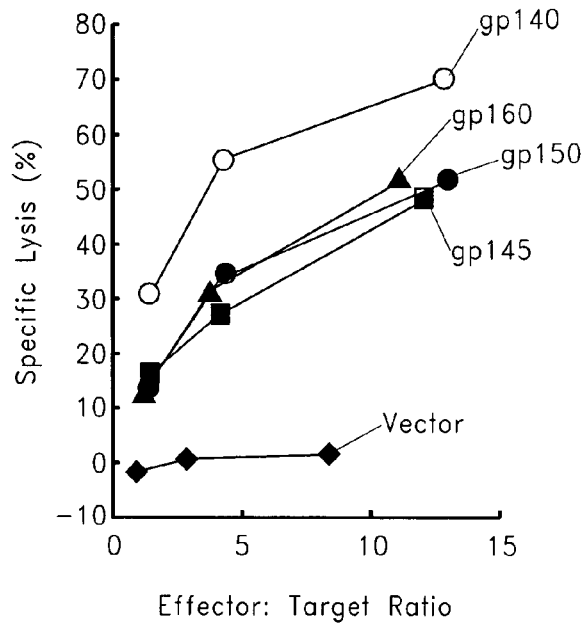
FIG. 183. CTL response against HIV-1 envelope proteins in DNA immunized mice. The CTL response to CXCR4-tropic Env and indicated deletion mutants is shown (A). Dependence of CTL activity on CD8 cells was shown by magnetic bead depletion using the indicated representative immunogens (B). The CTL responses to CXCR4-tropic envelope with glycosylation site and ΔCFI mutations are shown (C and D, respectively). Spleen cells were isolated from immunized mice two weeks after the final immunization and stimulated in vitro with irradiated cells expressing gp160 with addition of hIL2 (5 U/ml) at day 4. The cytolytic activity of the restimulated spleen cells was tested after 7 days against V3 peptide-pulsed BC10ME cells. Similar findings were observed with target express full-length Env.
Figure 183B:
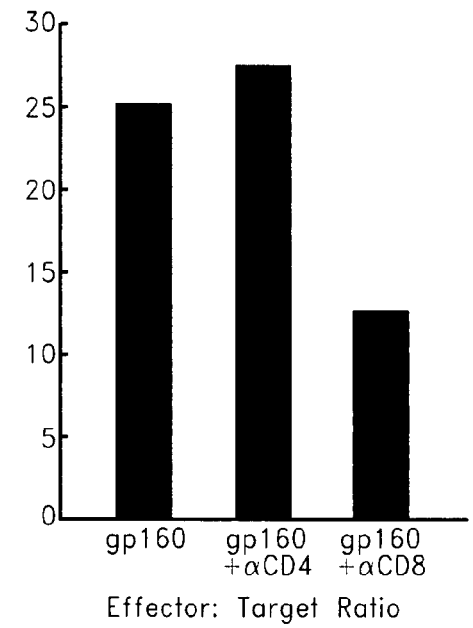
Figure 183C:
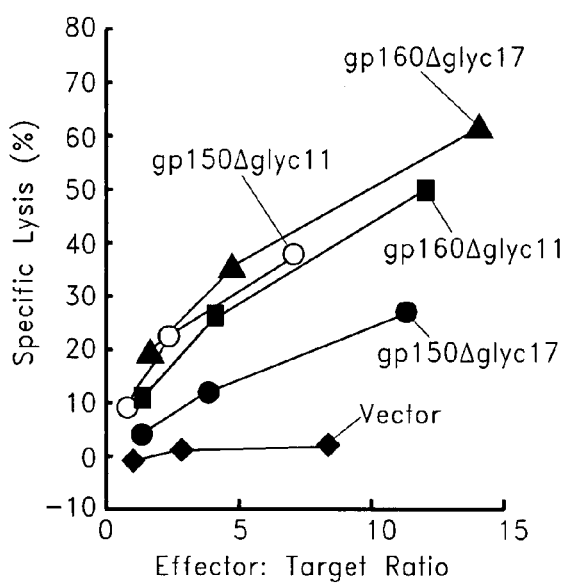
Figure 183D:
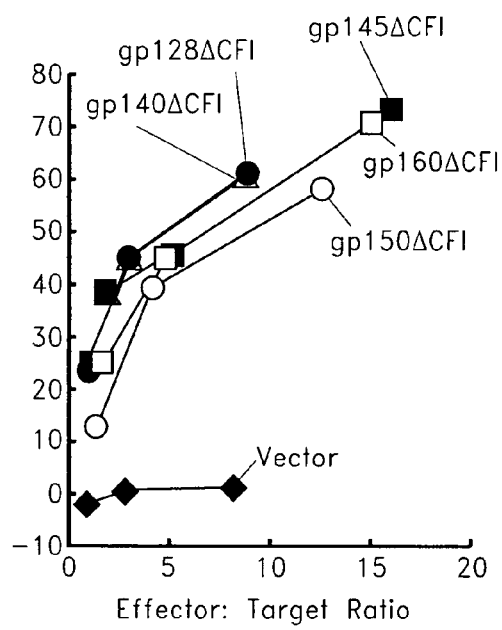

Recent reports suggest that gp160 forms trimers in vivo and the domain required for trimer formation resides in the ectodomain of the gp41. Such trimeric forms of HIV envelope protein are likely to present different epitopes to the immune system compared to monomeric gp120. In addition to the linear epitopes in the envelope, this trimeric structure is likely to expose conformational epitopes important for B cell triggering of a relevant antibody response. In this regard, gp140 (ΔCFI), which induced the greatest antibody response, is released in a soluble form (FIG. 181). In contrast, wild type Env did not elicit high titer antibody responses. The toxicity of Env in mammalian cells has been seen and could limit both the amount and duration of envelope protein expression in vivo that would affect immunogenicity. The envelope is also heavily glycosylated, and removal of partial or complete gp120 glycosylation sites has resulted in higher titers of strain-specific neutralizing antibody responses to mutant SIVs in monkeys. Though it seemed reasonable that deglycosylation would reveal epitopes otherwise masked in the native protein, we did not observe enhanced immune reactivity by DNA vaccination using different glycosylation site mutants, both in gp160 and gp150. This difference with the previous study is likely due to the fact that DNA vaccination rather than viral infection was utilized for immunization. Though glycosylation mutants are unlikely to prove helpful with this former method of immunization, we envision that modification of glycosylation sites will be effective with other vectors or adjuvants.

HIV-1 Env is proteolytically cleaved by a cellular convertase into gp120 and gp41. The gp41 subunit is composed of cytoplasmic, transmembrane, and ectodomain segments. The role of the ectodomain of the envelope in membrane fusion, particularly its hydrophobic glycine-rich fusion peptide, is well established. Two regions with heptad coiled-coil repeats in the ectodomain of gp41 are involved in viral fusion. Upon fusion, these two alpha helices, connected via a disulfide-stabilized loop, presumably undergo a transient conformational change to a fusion active state. These changes allow the formation of a six-member helical hairpin intermediate structure that presumably exposes the fusion peptide at the $NH_2$-terminus of gp41, allowing fusion to the target cell membrane. The ΔCFI mutation was intended to eliminate cleavage of gp140, remove the unstable hydrophobic region and stabilize oligomer formation. Though detailed structural data is not yet available on this protein, these mutations apparently stabilize Env in a conformation that elicits both humoral and cellular immune responses. For example, the neutralizing epitope in the ectodomain of gp41 is present in the series of deletions and truncations of the envelope and gp140 (ΔCFI) is reactive with the 2F5 neutralizing monoclonal antibody that binds to this epitope. Importantly, these immunogens also induced CTL responses to Env. Though gp128 (ΔCFI) induced slightly more potent CTL activity, gp140 (ΔCFI) was better able to elicit such responses, both to peptide-pulsed cells and stably transduced target cells. Thus the enhanced humoral immune response introduced by this vaccine candidate did not appear to diminish the CTL response. Taken together, these results indicate that gp140ΔCFI serves as an improved immunogen that can more effectively elicit an antibody response against the envelope by DNA vaccination while preserving its ability to induce a CTL response.

Gag and Pol

In this disclosure, we have prepared synthetic HIV-1 B clade Gag and Pol expression vectors that are based on human (h) codon usage. These vectors encode hGag-Pol and its derivatives, hGag, hPol and an hGag-Pol fusion protein. The synthetic Gag-Pol genes show little nucleotide homology to HIV-1 but are the same in protein sequence. The modified Gag-Pol genes were subcloned into a eukaryotic plasmid expression vector for expression and DNA immunization studies. Synthetic Gag-Pol genes allowed high level Rev-independent expression of HIV-1 Gag-Pol precursor proteins in human and mouse cell lines and induced significant cellular and humoral responses in mice. The Gag-Pol fusion protein induced the broadest responses to Gag and Pol determinants and thus is envisioned as a prototype immunogen that maximizes epitope presentation.

Eliminating the Frame Shift Site to Create Viral Polyproteins

Described herein are HIV Gag-Pol fusion proteins encoded by a continuous open reading frame so to improve the immune response to native Gag and Pol. In some viruses, translational frame shifting is exploited during protein synthesis. Specific sequences in the RNA are required for the frame shifting. The viral RNA sequences cause ribosomal slippage so that viral proteins are produced in non-equivalent ratios. For example, during translation in HIV, the ribosomes shift reading frames to synthesize Gag precursor protein and the gag-pol fusion protein in a 20:1 ratio. The strategy here is to maximize epitope presentation by transcribing an immunogen from a continuous open reading frame by eliminating the frame shift site. Thus, the strategy for improving the immune response by the use of a HIV Gag-Pol fusion protein encoded by a continuous open reading frame extends to other viral proteins that are produced in non-equivalent ratios by virtue of translational frame shifting.

The present invention involves HIV Gag-Pol fusion proteins encoded by a single continuous open reading frame due to mutation of the frame shift site. The frame shift site is mutated by deletions, insertions, and/or substitutions of nucleotides to create a single continuous open reading frame. In one embodiment, deletions are meant (i.e., nucleotides are deleted to create the same open reading frame).

The frame shift site is a mutated frame shift to create a single continuous open reading frame. For example, a set of similar retroviral gag-pol frame shift sites are optionally made for a given fusion protein, for example, by synthesizing different gag-pol frame shift regions and cloning the sequences appropriately, or by site-directed mutagenesis of a given frame shift clone. The efficacy of the frame shift sites are assessed by measuring the production of the fusion protein. The sequence that shows the highest level of expression is a "optimized" frame shift mutation for the set assessed. Alternatively, where a particular level of expression is desired, a frame shift site from a particular set of possible frame shift sites which is closest to the desired activity level is considered to be "optimized."

Although a full length Gag sequence is preferred for use in the fusion protein of the present invention, Gag is optionally deleted of subsequences without negating a polyepitope response. For example, regions of the matrix protein (p17), regions of the capsid protein (p24), regions of p2, regions of the nucleocapsid protein (p7), regions of p1, and regions of p6 can be deleted while preserving the polyepitope response.

Alternatively, regions of the matrix protein (p17), regions of the capsid protein (p24), regions of p2, regions of the nucleocapsid protein (p7), regions of p1, and regions of p6 can be substituted while preserving the polyepitope response. Alternatively, regions of the matrix protein (p17), regions of the capsid protein (p24), regions of p2, regions of the nucleocapsid protein (p7), regions of p1, and regions of p6 can be interrupted by insertions while preserving the polyepitope response. Optionally, regions of the matrix protein (p17), regions of the capsid protein (p24), regions of p2, regions of the nucleocapsid protein (p7), regions of p1, and regions of p6 can be mutated to inactivate these proteins.

Likewise, a full length Pol sequence is preferred for use in the fusion protein of the present invention, and Pol is optionally deleted of subsequences without negating a polyepitope response. For example, regions of the protease protein, regions of the reverse transcriptase protein, and regions of the integrase protein can be deleted while preserving the polyepitope response. Alternatively, regions of the protease protein, regions of the reverse transcriptase protein, and regions of the integrase protein can be substituted while preserving the polyepitope response. Alternatively, regions of the protease protein, regions of the reverse transcriptase protein, and regions of the integrase protein can be interrupted by insertions while preserving the polyepitope response. Optionally, regions of the protease protein, regions of the reverse transcriptase protein, and regions of the integrase protein can be mutate to inactivate these enzymes.

In other embodiments, the Gag-Pol fusion proteins are co-expressed with other proteins, either as fusion proteins or separately, preferably with Env sequence proteins, such as the modified HIV Env ΔCFI proteins described herein.

In another aspect, the invention involves chimeric nucleic acid molecules. The chimeric nucleic acid molecules of the invention typically have a retroviral gag nucleic acid sequence and a retroviral pol nucleic acid sequence in the same open reading frame due to mutation of the frame shift site. The continuous open reading frame encodes a fusion protein such as those described above.

The chimeric nucleic acids of the present invention are optionally DNA, RNA, or mRNA. Most typically, the chimeric nucleic acids are provided by recombinantly making a DNA, which is expressed in a cell as RNA and/or as mRNA. Given the strategy for making the chimeric nucleic acids of the present invention, one of skill can construct a variety of clones containing functionally equivalent nucleic acids. Cloning methodologies to accomplish these ends, and sequencing methods to verify the sequence of nucleic acids are well known in the art. Examples of appropriate cloning and sequencing techniques, and instructions sufficient to direct persons of skill through many cloning exercises are found in Berger and Kimmel, Guide to Molecular Cloning Techniques, Methods in Enzymology, volume 152, Academic Press, Inc., San Diego, Calif. (Berger); Sambrook, et al. (1989) Molecular Cloning—A Laboratory Manual (2nd ed.) Vol. 1-3, Cold Spring Harbor Laboratory, Cold Spring Harbor Press, N.Y., (Sambrook); and Current Protocols in Molecular Biology, F. M. Ausubel, et al., eds., Current Protocols, a joint venture between Greene Publishing Associates, Inc. and John Wiley & Sons, Inc., (1994 Supplement) (Ausubel). Product information from manufacturers of biological reagents and experimental equipment also provide information useful in known biological methods. Such manufacturers include the SIGMA chemical company (Saint Louis, Mo.), R&D systems (Minneapolis, Minn.), Pharmacia LKB Biotechnology (Piscataway, N.J.), CLONTECH Laboratories, Inc. (Palo Alto, Calif.), Chem Genes Corp., Aldrich Chemical Company (Milwaukee, Wis.), Glen Research, Inc., GIBCO BRL Life Technologies, Inc. (Gaithersburg, Md.), Fluka Chemica-Biochemika Analytika (Fluka Chemie A G, Buchs, Switzerland), Invitrogen, San Diego, Calif., and Applied Biosystems (Foster City, Calif.), as well as many other commercial sources known to one of skill.

The chimeric nucleic acid compositions of this invention, whether RNA, cDNA, mRNA, genomic DNA, or a hybrid of the various combinations, are isolated from biological sources or synthesized in vitro. The chimeric nucleic acids of the present invention are present in transformed or transfected whole cells, in transformed or transfected cell lysates, or in a partially purified or substantially pure form.

In vitro amplification techniques suitable for amplifying sequences to provide a nucleic acid or for subsequent analysis, sequencing or subcloning are known. Examples of techniques sufficient to direct persons of skill through such in vitro amplification methods, including the polymerase chain reaction (PCR) the ligase chain reaction (LCR), Qβ-replicase amplification and other RNA polymerase mediated techniques (e.g., NASBA) are found in Berger, Sambrook, and Ausubel, as well as Mullis, et al., (1987) U.S. Pat. No. 4,683,202; PCR Protocols A Guide to Methods and Applications (Innis, et al. eds) Academic Press Inc. San Diego, Calif. (1990) (Innis); Arnheim & Levinson (Oct. 1, 1990) C&EN 36-47; The Journal Of NIH Research (1991) 3: 81-94; Kwoh, et al., Proc. Natl. Acad. Sci. USA, 86: 1173 (1989); Guatelli, et al., Proc. Natl. Acad. Sci. USA, 87: 1874 (1990); Lomell, et al., J. Clin. Chem., 35: 1826 (1989); Landegren, et al., Science, 241: 1077-1080 (1988); Van Brunt, Biotechnology, 8: 291-294 (1990); Wu and Wallace, Gene, 4: 560 (1989); Barringer, et al., Gene, 89: 117 (1990), and Sooknanan and Malek, Biotechnology, 13: 563-564 (1995). Improved methods of cloning in vitro amplified nucleic acids are described in Wallace, et al., U.S. Pat. No. 5,426,039. Improved methods of amplifying large nucleic acids (up to 40 kb) are summarized in Cheng, et al., Nature, 369: 684-685 (1994) and the references therein. One of skill will appreciate that essentially any RNA can be converted into a double stranded DNA suitable for restriction digestion, PCR expansion and sequencing using reverse transcriptase and a polymerase. See, Ausubel, Sambrook, Innis, and Berger, all supra.

One of skill will recognize many ways of generating alterations in a given nucleic acid construct. Such well-known methods include site-directed mutagenesis, PCR amplification using degenerate oligonucleotides, exposure of cells containing the nucleic acid to mutagenic agents or radiation, chemical synthesis of a desired oligonucleotide (e.g., in conjunction with ligation and/or cloning to generate large nucleic acids) and other well-known techniques. See, Giliman and Smith, Gene 8: 81-97 (1979), Roberts, et al., Nature, 328: 731-734 (1987) and Sambrook, Innis, Ausubel, Berger, and Mullis (all supra).

Most modifications to nucleic acids are evaluated by routine screening techniques in suitable assays for the desired characteristic. For instance, changes in the immunological character of encoded polypeptides can be detected by an appropriate immunological assay. For instance, changes in the cellular immunological character of the polypeptide can be detected by an appropriate antibody or CTL assay. Modifications of other properties such as nucleic acid hybridization to a complementary nucleic acid, redox or thermal stability of encoded proteins, hydrophobicity, susceptibility to proteolysis, or the tendency to aggregate are all assayed according to standard techniques.

A wide variety of formats and labels are available and appropriate for detection of fusion protein sequences. These include analytic biochemical methods such as spectrophotometry, radiography, electrophoresis, capillary electrophoresis, high performance liquid chromatography (HPLC), thin layer chromatography (TLC), hyperdiffusion chromatography, and the like, and various immunological methods such as fluid or gel precipitin reactions, immunodiffusion (single or double), immunoelectrophoresis, radioimmunoassays (RIAs), enzyme-linked immunosorbent assays (ELISAs), western blot assays, immunofluorescent assays, and the like. Several commercially available ELISA assays for the detection of retroviral components, including Env domains, are available, allowing one of skill to detect Env in biological samples.

Similarly, the detection of the chimeric nucleic acids of the present invention proceeds by well known methods such as Southern analysis, northern analysis, gel electrophoresis, PCR, radiolabeling and scintillation counting, and affinity chromatography. Many assay formats are appropriate, including those reviewed in Tijssen (1993) Laboratory Techniques in biochemistry and molecular biology—hybridization with nucleic acid probes parts I and II, Elsevier, New York and Choo (ed) (1994) Methods In Molecular Biology Volume 33—In Situ Hybridization Protocols, Humana Press Inc., New Jersey (see also, other books in the Methods in Molecular Biology series); see especially, Chapter 21 of Choo (id.) "Detection of Virus Nucleic Acids by Radioactive and Nonisotopic in Situ Hybridization". Finally, PCR is also routinely used to detect nucleic acids in biological samples (see, Innis, supra, for a general description of PCR techniques).

In one preferred embodiment, antibodies are used to detect polypeptide sequences. Methods of producing polyclonal and monoclonal antibodies are known to those of skill in the art, and many anti-HIV antibodies are available. See, e.g., Coligan (1991) Current Protocols in Immunology, Wiley/Greene, NY; and Harlow and Lane (1989) Antibodies: A Laboratory Manual, Cold Spring Harbor Press, NY; Stites, et al. (eds.) Basic and Clinical Immunology (4th ed.), Lange Medical Publications, Los Altos, Calif., and references cited therein; Goding (1986) Monoclonal Antibodies: Principles and Practice (2d ed.), Academic Press, New York, N.Y.; and Kohler and Milstein, Nature, 256: 495-497 (1975). Other suitable techniques for antibody preparation include selection of libraries of recombinant antibodies in phage or similar vectors. See, Huse, et al., Science, 246: 1275-1281 (1989); and Ward, et al., Nature, 341: 544-546 (1989). Specific monoclonal and polyclonal antibodies and antisera will usually bind with a KD of at least about 0.1 mM, more usually at least about 1 μM, preferably at least about 0.1 μM or better, and most typically and preferably, 0.01 μM or better.

Expression of Synthetic HIV-1 Gag and Pol Genes

Figure 184:
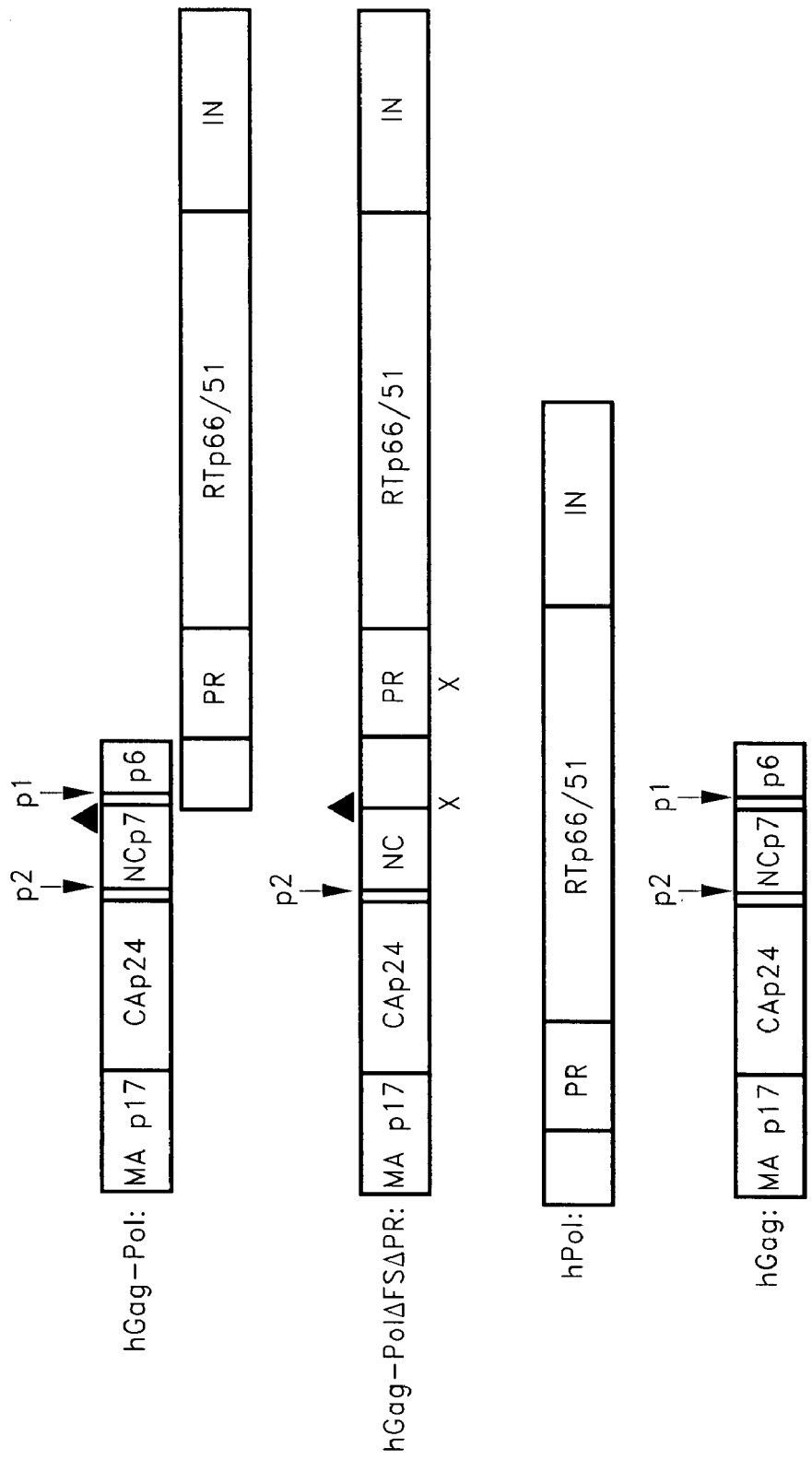
FIG. 184. Schematic representation of HIV-1 Gag-Pol expression constructs. The protein sequences of Gag (amino acids 1-432) from HXB2 (GenBank accession number K03455) and Pol (amino acids 3-1003) from NL4-3 (GenBank accession number M19921) were used to create a synthetic version of hGag-Pol using codons found in human cells. Gag-PolΔFSΔPr was made by modification of the frame shift site (FS) and inactivation of protease. For hPol, 432 amino acids were deleted from the $NH_2$-terminal region of hGag-Pol and addition of an ATG codon. hGag was made by deletion of 925 amino acids from the COOH-terminal region of hGag-Pol. hGag-Pol, hGag-PolΔFSΔPr, hPol and hGag are expressed from the pNGVL-3 vector backbone.
Figure 186:
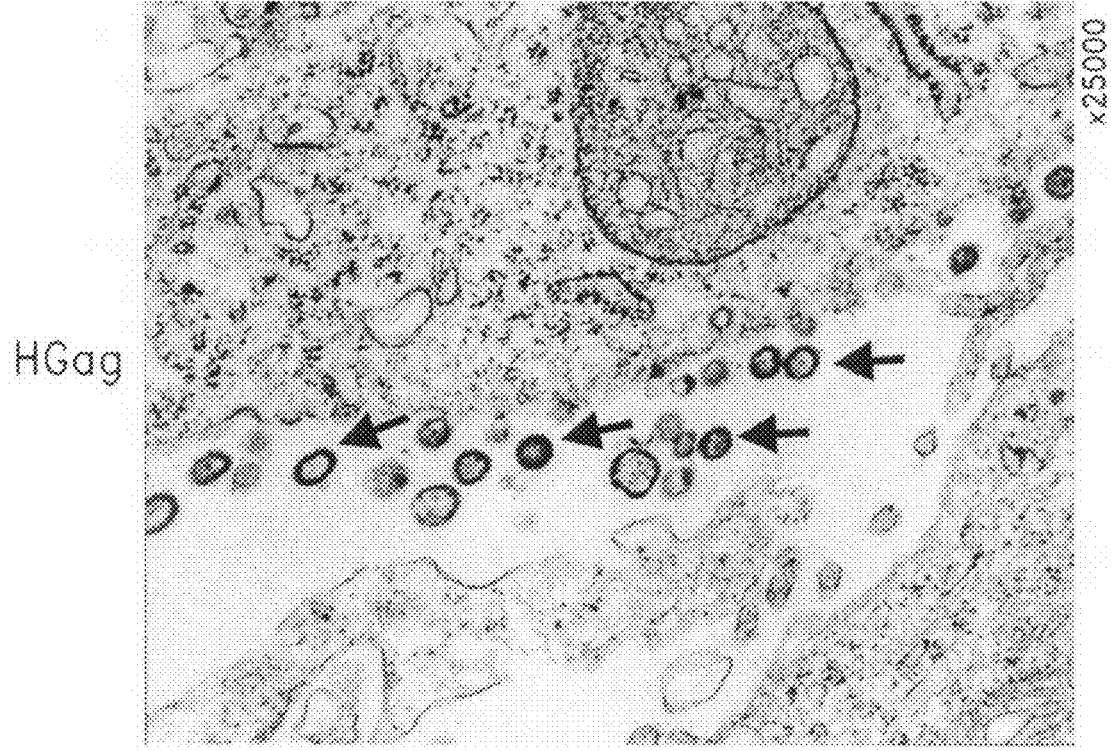
FIG. 186. Transmission electron microscopy of HIV-1 immature virus-like particles (VLP) produced by transfected 293T. Cells were transfected with pNGVL-hGag 48 hours prior to harvesting and fixing (magnification 25,000×).

Four synthetic HIV-1 Gag- and/or Pol expression vectors, hGag-Pol, hGag-PolΔFsΔPr, hPol and hGag genes were prepared (FIG. 184). To confirm expression, the synthetic or viral Gag-Pol genes were transiently transfected into 293T cells, a human kidney-derived cell line. When cell lysates were analyzed by immunoblotting with human anti-HIV-1 IgG (FIG. 185A), monoclonal anti-p24 (FIG. 185B), and rabbit anti-RT (FIG. 185C), Gag p55, Pol p110 and Gag-Pol p160 precursor proteins were detected in hGag, hPol, and hGag-Pol fusion plasmids transfected 293T cells, as was expected. Mature virion proteins, p24 and RTp66, were detected in the hGag-Pol gene transfected cells (FIGS. 185A, B and C). This might be a result of the activation of protease inside cells which was itself a result of the high-level expression of Gag and Gag-Pol protein. The expression of Gag precursor proteins from codon-altered vectors was ≧10-fold higher than viral Gag-Pol (FIG. 185), determined by quantitative phosphorimaging. The level of accumulated Gag-Pol fusion protein was 100-fold higher in cells transfected with hGag-Pol compared to viral Gag-Pol. Virus-like particles were released from the hGag gene transfected cells (FIG. 186), detected by transmission electron microscopy. Though such particles were observed at a lower frequency with hGag-Pol, no particles were seen in cells transfected with hGag-PolΔFsΔPr or hPol vectors. Stable expression of HIV-1 Gag and Pol proteins from codon-optimized genes in mouse CT26 and BH10ME cells was also observed (FIG. 185D).

Induction of HIV-1 Gag and Pol CTL Responses in Mice by DNA Vaccination

To evaluate the cellular immune response to HIV-1 Gag and Pol proteins, Balb/C female mice were injected intramuscularly with the eukaryotic expression vector plasmids containing the codon-optimized genes. Two weeks after the final vaccination, splenocytes were harvested from the immunized mice and sensitized with either Gag or Pol peptide-pulsed naïve mouse splenocytes. One week later, CTL responses were analyzed using a 5-hour chromium release assay.

Figure 187C:
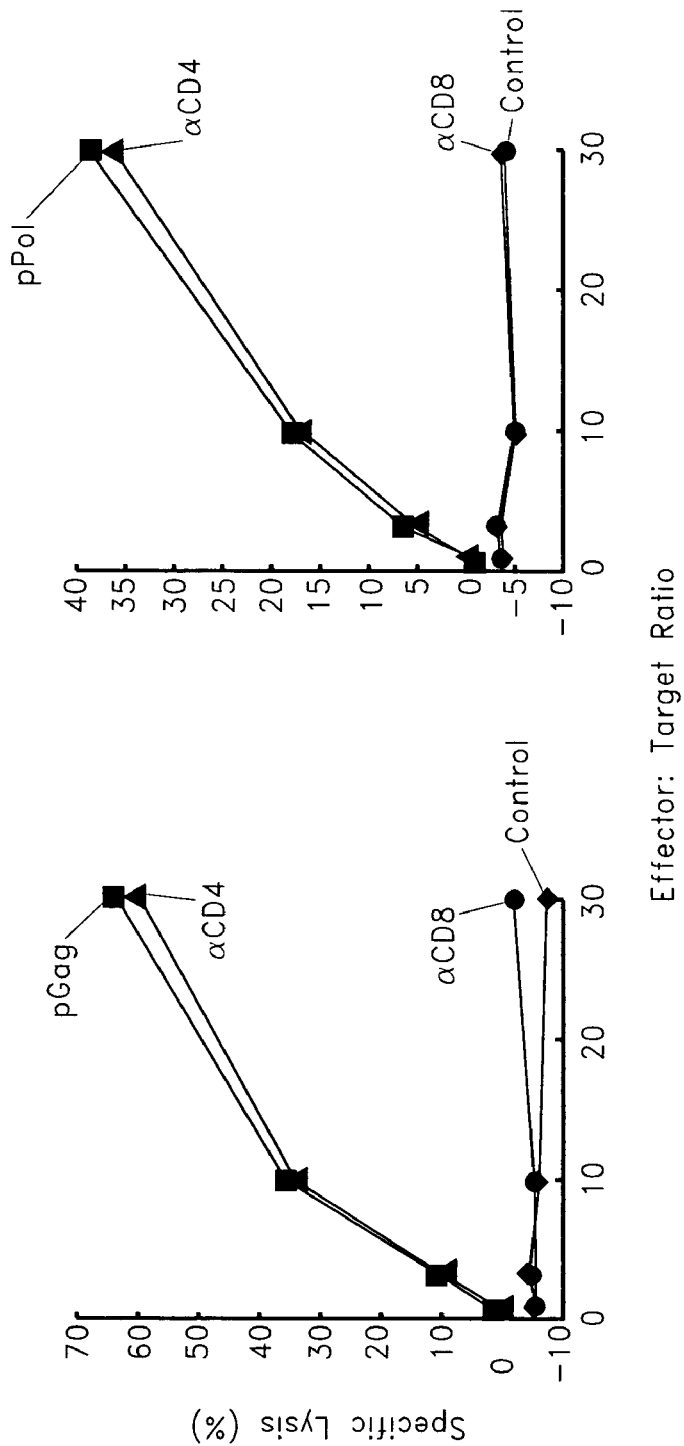
FIG. 187. Gag or Pol specific CTL response mediated by CD8 positive cells in immunized mice. Two weeks after mice were immunized with a control vector, hGag, hPol, hGag-PolΔFSΔPr, and hGag-Pol, splenic cells were harvested and sensitized with naïve mouse splenic cells pulsed with Gag or Pol peptides. One week later, effector cells were tested for cytolytic activity in a 5-h $^{51}$Cr release assay using $^{51}$Cr-labeled BC10ME target cells that were pulsed for 2 hours with either (A) HIV-1 Gag peptides, or (B) HIV-1 Pol peptides. (C) CD4+ or CD8+ lymphocytes were depleted from splenic cells of immunized mice with anti-mouse-CD4+ or CD8+ Dynal beads according to the manufacturer's instructions.

CTL responses specific to HIV-1 Gag and/or Pol were first analyzed using Gag or Pol peptide-pulsed BC10ME cells, or mouse fibrosarcoma cell lines derived from B/C—N cells. Immunization with hGag, hGag-PolΔFSΔPr or hGag-Pol genes induced comparably strong CTL responses specific to Gag (FIG. 187A); however, after immunization with hPol, hGag-PolΔFSΔPr or hGag-Pol genes, only the fusion protein, hGag-PolΔFSΔPr, and hPol to a lesser extent, elicited a marked CTL response to Pol (FIG. 187B). To confirm that the specific killing in the CTL assays was induced by CD8+ cytotoxic T lymphocytes, CD4+ or CD8+ cells were depleted from sensitized splenocytes by Dynal beads (Dynal, Inc., Lake Success, N.Y.). Depletion of CD8+ cells abolished the specific lysis in the hGag-Pol ΔFSΔPr gene-immunized mice, while depletion of CD4+ had little effect on lysis (FIG. 187C), suggesting that CD8+ lymphocytes were responsible for specific cytotoxicity.

Figure 188A:
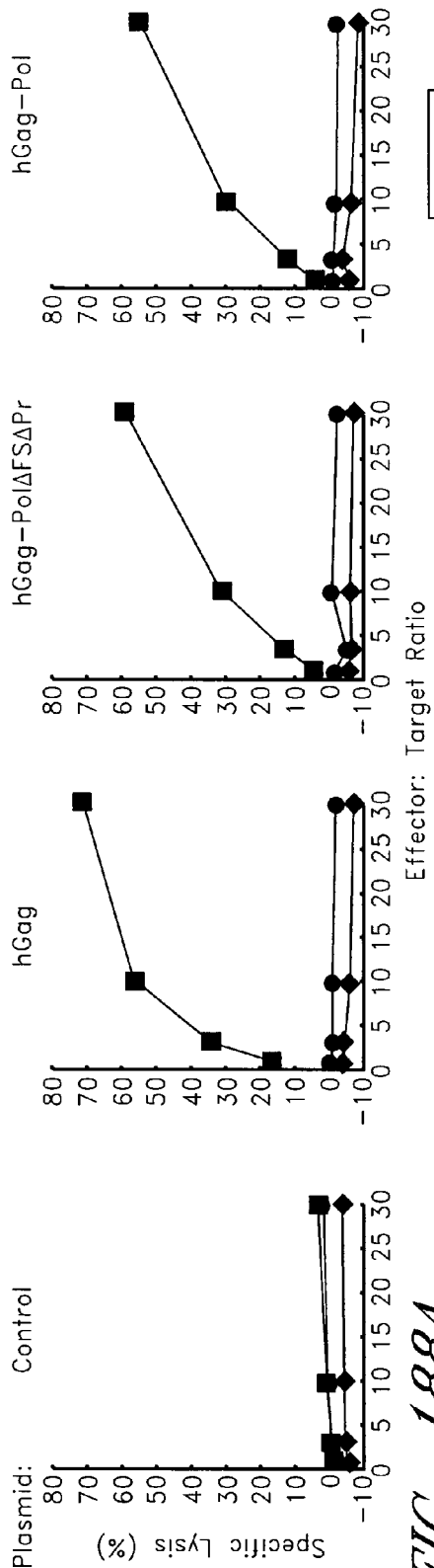
FIG. 188. Gag or Pol specific CTL response mediated by CD8 positive cells in immunized mice using stable expressing cell lines as target cells. Two weeks after immunization in mice, splenic cells were harvested and sensitized with naïve mouse splenic cells pulsed with Gag or Pol peptides. One week later, effector cells were tested for cytolytic activity in a 5-h $^{51}$Cr release assay using $^{51}$Cr-labeled BC10ME target cells expressing either (A) HIV-1 Gag or (B) Pol protein.
Figure 188B:
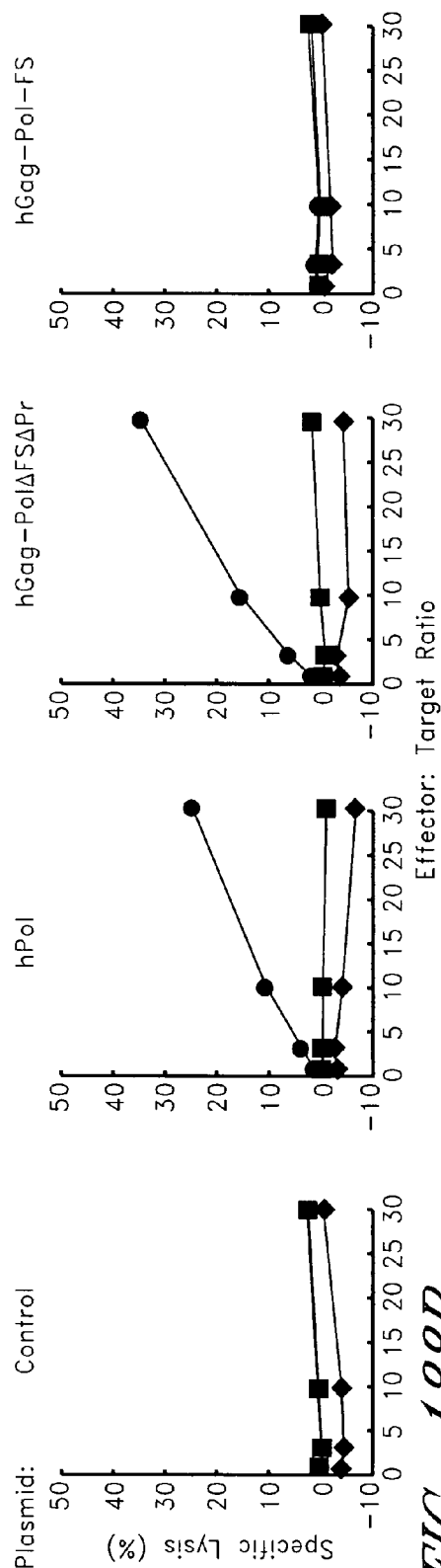

The responses were further analyzed and confirmed with the hGag or hPol gene transduced syngeneic CT26 and BC10ME cell lines. Responses to Gag in the mice immunized with the hGag, hGag-PolΔFSΔPr or hGag-Pol genes were similar when peptide-pulsed cells were used as targets in the CTL assay (FIG. 188A). Mice immunized with the hPol gene generated a specific response to HIV-1 Pol on BC10ME cell lines stably expressing Pol as target cells (FIG. 188B). The same results have been observed with CT26 cell lines. These stably transfected cell lines were therefore more sensitive as target cells than peptide-pulsed cells in the Pol CTL assays.

Antibody Response in the Immunized Mice

Sera from mice immunized with different plasmids was analyzed with a p24 ELISA. hGag immunized mice demonstrated the highest p24 antibody titers (FIG. 189A). Unexpectedly, hGag-Pol virus-like particles elicited the lowest levels of p24 antibody. Similar results were observed by Western blotting with pooled sera (FIG. 189B). The HIV-1 Pol specific antibodies were not detected by a commercially available Western blotting kit (FIG. 189B), but antibodies to Pol were detected in mice immunized with hPol and hGag-PolΔFSΔPr with a more sensitive method, IP/Western blotting (FIG. 189C). Presumably, this assay is more sensitive and better able to detect native conformational epitopes. Though such antibodies were found in mice immunized with Pol and Gag-Pol fusion proteins in this assay, minimal response was detected in the mice immunized with hGag-Pol. Though both immunogens elicited similar Gag responses, the Gag-Pol fusion protein was therefore more effective in the stimulation of CTL and antibody responses to Pol.

HIV Gag-Pol Fusion Proteins

In this disclosure, HIV-1 B-clade Gag and Pol genes were modified to increase Rev-independent expression of HIV-1 Gag-Pol proteins. This modification allowed synthesis of HIV Gag and Pol, as well as fusion proteins at levels 10- to 100-fold higher than the corresponding Rev-dependent viral gene in the absence of Rev and RRE elements. These viral proteins were recognized by standard polyclonal and monoclonal antibodies (FIG. 185), and immature VLP were produced and released from 293T cells transfected with hGag (FIG. 186).

The immune response induced by Rev-independent Gag-Pol was directed against both Gag and Pol determinants. The hGag, hGag-Pol fusion and hGag-Pol all induced strong CTL responses specific for Gag in mice immunized with plasmid DNA, but a significant Pol response was elicited only in the mice immunized with the hGag-PolΔFSΔPr or Pol alone. Because immunization with hGag-Pol gene failed to induce detectable cellular or humoral responses to HIV-1 Pol protein, these findings indicate that the Gag-Pol fusion protein induces a broader range of responses and allows delivery of an immunogen with a larger number of epitopes in a single continuous open reading frame. During viral replication, viral gag-pol produces Gag precursor protein and the gag-pol fusion protein by frame shifting in a 20:1 ratio (Wilson, W et al., 1988, Cell, 55: 1159-1169). The deletion of a frame shift site in hGag-PolΔFSΔPr results in production of only the Gag-Pol fusion protein. Expression of Gag-Pol proteins alone in human cells is not adequate to form releasable viral particles because HIV-1 viral assembly requires Gag precursor proteins (Park, J and CD Morrow, 1992, J Virol, 66: 6304-6313; Smith, A J et al., 1993, J Virol, 67: 2266-2275). The ability of hGag-PolΔFSΔPr to elicit strong Gag and Pol specific CTL responses in mice may be explained by high level expression of Gag-Pol fusion protein and its retention on the inside of cells, which could create a new condition not existing during normal viral replication and could provide sufficient proteins for antigen presentation. Moreover, the mutation in viral protease prevents viral protein from intracellular activation and reduced cellular toxicity. Overexpression of this polyprotein is also likely to affect its intracellular localization/transport and is envisioned as improving antigen presentation.

The Pol gene of HIV-1 is the precursor protein for viral protease, reverse transcriptase and integrase, which are crucial to viral replication (Kohl, N E et al., 1988, Proc. Natl. Acad. Sci. USA, 85: 4686-4690.). Retroviral extracellular maturation, resulting from self-activation of protease after release produces mature RT and IN which have important functions in reverse transcription and integration respectively, for HIV-1, HIV-2, and SIV replication. The catalytic cores of these enzymes have relatively conserved domains in order to preserve their functions and thus are envisioned as inducing cross-clade CTL responses. As early as 1988, CTLs specific for HIV-1 RT were found in blood samples from HIV-1 infected individuals (Hosmalin, A et al., 1990, Proc. Natl. Acad. Sci. USA, 87: 2344-2348; Walker, B D et al., 1988, Science, 240: 64-66.). Relatively strong Gag-specific CTL responses have been shown in numerous non-human primate and human studies, using DNA vaccines or a live recombinant vector containing viral Gag-Pol constructs (Evans, TG, 1999, J Infect Dis, 180: 290-298; Ferrari, G, 1997, Blood, 90: 2406-2416; Gorse, G J et al., 1999, Vaccine, 18: 835-849; Seth, A, 1998, Proc. Natl. Acad. Sci. USA, 95: 10112-10116; Seth, A et al., 2000, J Virol, 74: 2502-2509), but fewer Pol-specific CTL responses have been reported. The detection of significant CTL responses specific to Pol in our disclosure may be attributed in part to establishment of stable Pol expressing cell lines, in which codon alteration and inactivation of FS and PR in the Pol gene allow high level expression of the Pol protein without cellular toxicity. Though it remains possible that the hGag-Pol, or a combination of hGag and hPol, may exert similar effects with appropriate adjuvants or with different prime-boost regimens, the Rev-independent Gag-Pol fusion protein stimulates HIV-1 Gag and Pol specific CTL responses in mice and is envisioned as proving useful in an AIDS vaccine.

Plasmid Descriptions

Env Plasmids

VRC2100 pVR1012x/s R5gp139-Nef (delta) MHC (delta) CD4/h

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. The envelope protein gene from pX4gp160/h (Nabel lab #1272) was ligated in frame with the mutant Nef gene from pNefDMHCDCD4/h (Nabel lab #1278) to produce pX4gp139-NefDMHCDCD4/h. The envelope-Nef fusion protein expressed from pX4gp139-NefDMHCDCD4/h contains the first 668 amino acids from the HIV envelope glycoprotein (gp139) fused to the entire mutant Nef protein. The truncated envelope polyprotein (gp139) contains the entire SU protein and a portion of the TM protein including the fusion domain, but lacking the transmembrane domain and regions important for oligomer formation. The protein sequence of the Nef protein from HIV-1 PV22 (GenBank accession number K02083) was used to create a synthetic version of the Nef gene (Nef/h) using codons optimized for expression in human cells. To disrupt the ability of Nef to limit both MHC class I and CD4 expression, point mutations were introduced into the Nef gene from pNef/h (Nabel lab #1275). The resulting amino acids substitutions in pNefDMHCDCD4/h are: P69A, P72A, P75A, P78A, D174A and D175A. X4gp139-NefDMHCDCD4/h is expressed from the pVR1012x/s (Nabel lab #1267) vector backbone.

VRC2200 pVR1012x/s R5gp157-Nef (delta) MHC (delta) CD4/h

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (Nabel lab number 1272) were replaced with the corresponding region from the BaL strain of HIV-1 (GeneBank accession number M68893, again using human preferred codons). The envelope-Nef fusion protein expressed from pR5gp157-Nef/h contains the first 820 amino acids from the HIV envelope glycoprotein (gp157) fused to the entire mutant Nef protein. The gene for gp157 was ligated in frame with the full-length mutant Nef gene from pNefDMHCDCD4/h (Nabel lab #1278) to produce pR5gp157-NefDMHCDCD4/h. The protein sequence of the Nef protein from HIV-1 PV22 (GenBank accession number K02083) was used to create a synthetic version of the Nef gene (Nef/h) using codons optimized for expression in human cells. To disrupt the ability of Nef to limit both MHC class I and CD4 expression, point mutations were introduced into the Nef gene from pNef/h (Nabel lab #1275). The resulting amino acids substitutions in pNefDMHCDCD4/h are: P69A, P72A, P75A, P78A, D174A and D175A. R5gp157-NefDMHCDCD4/h is expressed from the pVR1012x/s (Nabel lab #1267) vector backbone.

VRC2300 pVR1012x/s X4 gp139-Nef deltaMHC deltaCD4/h

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. The envelope protein gene from pX4gp160/h (Nabel lab #1272) was ligated in frame with the mutant Nef gene from pNefDMHC/h (Nabel lab #1276) to produce pX4gp139-NefDMHC/h. The envelope-Nef fusion protein expressed from pX4gp139-NefDMHC/h contains the first 668 amino acids from the HIV envelope glycoprotein (gp139) fused to the entire mutant Nef protein. The truncated envelope polyprotein (gp139) contains the entire SU protein and a portion of the TM protein including the fusion domain, but lacking the transmembrane domain and regions important for oligomer formation. The protein sequence of the Nef protein from HIV-1 PV22 (GenBank accession number K02083) was used to create a synthetic version of the Nef gene (Nef/h) using codons optimized for expression in human cells. To disrupt the ability of Nef to limit MHC class I expression, point mutations were introduced into the Nef gene from pNef/h (Nabel lab #1275). The resulting amino acids substitutions in pNefDMHC/h are: P69A, P72A, P75A, and P78A. X4gp139-NefDMHC/h is expressed from the pVR1012x/s (Nabel lab #1267) vector backbone

VRC2302 pVR1012x/s X4gp130-Nef/h

For the X4gp130/h (VRC2703) portion, the protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, and P470L. The full-length X4-tropic version of the envelope protein from pX4gp160/h (VRC3300) was terminated after the codon for amino acid 602. The truncated envelope polyprotein contains the entire SU protein and a portion of the TM protein including the fusion domain, but lacking the transmembrane domain. Heptad(H) 1, Heptad 2 and their Interspace(IS) are required for oligomerization. Regions important for oligomer formation may be partially functional. This X4gp130/h (VRC2703) gene was fused to Nef gene. The Nef protein from HIV-1 PV22 (GenBank accession number K02083) was used to create the viral Nef gene (pVR1012-Nef)(Nabel Lab #1093. The nucleotide sequence is homologous to the viral gene, and the protein encoded is the same. The expression vector backbone is pVR1012x/s (VRC2000).

VRC2400 pVR1012x/s X4gp157-NefDMHCDCD4/h

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. The envelope-Nef fusion protein expressed from pX4gp157-NefDMHCDCD4/h contains the first 820 amino acids from the HIV envelope glycoprotein (gp157) fused to the entire mutant Nef protein. The truncated envelope polyprotein (gp157) contains the entire SU protein and a portion of the TM protein including the fusion domain, the transmembrane domain and regions important for oligomer formation. Heptad(H) 1, Heptad 2 and their Interspace(IS) are required for oligomerization. The gene for gp157 was ligated in frame with the full-length mutant Nef gene from pNefDMHCDCD4/h (VRC3600) to produce pX4gp157-NefDMHCDCD4/h. The protein sequence of the Nef protein from HIV-1 PV22 (GenBank accession number K02083) was used to create a synthetic version of the Nef gene (Nef/h) using codons optimized for expression in human cells. To disrupt the ability of Nef to limit both MHC class I and CD4 expression, point mutations were introduced into the Nef gene from pNef/h (VRC3500). The resulting amino acids substitutions in pNefDMHCDCD4/h are: P69A, P72A, P75A, P78A, D174A and D175A. X4gp160-NefDMHCDCD4/h is expressed from the pVR1012x/s (VRC2000) vector backbone.

VRC2700 pVR1012x/s X4gp140/h

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. The full-length X4-tropic version of the envelope protein from pX4gp160/h (VRC3300) was terminated after the codon for amino acid 680. The truncated envelope polyprotein contains the entire SU protein and a portion of the TM protein including the fusion domain, but lacking the transmembrane domain. Regions important for oligomer formation may be partially functional. Heptad(H) 1, Heptad 2 and their Interspace(IS) are required for oligomerization. The expression vector backbone is pVR1012x/s (VRC2000).

VRC2701 pVR1012x/s X4 gp140(del F/CL del H IS)/h

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, and P470L. The full-length X4-tropic version of the envelope protein from pX4gp160/h (VRC3300) was terminated after the codon for amino acid 680. The truncated envelope polyprotein contains the entire SU protein and a portion of the TM protein including the fusion domain, but lacking the transmembrane domain. Regions important for oligomer formation may be partially functional. Heptad(H) 1, Heptad 2 and their Interspace(IS) are required for oligomerization. The Fusion and Cleavage (F/CL) domains, from amino acids 503-536, have been deleted. The Interspace (IS) between Heptad (H) 1 and 2, from amino acids 593-620, have been deleted. The expression vector backbone is pVR1012x/s (VRC2000).

VRC2702 pVR1012x/s X4gp128(del F/CL)/h

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, and P470L. The full-length X4-tropic version of the envelope protein from pX4gp160/h (VRC3300) was terminated after the codon for amino acid 592. The truncated envelope polyprotein contains the entire SU protein and a portion of the TM protein including the fusion domain, but lacking the transmembrane domain. Regions important for oligomer formation may be partially functional. Heptad(H) 1, Heptad 2 and their Interspace(IS) are required for oligomerization. The Fusion and Cleavage (F/CL) domains, from amino acids 503-536, have been deleted. The expression vector backbone is pVR1012x/s (VRC2000).

VRC2706 pVR1012x/s X4gp145/h

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, and P470L. The full-length X4-tropic version of the envelope protein from pX4gp160/h (VRC3300) was terminated after the codon for amino acid 704. The truncated envelope polyprotein contains the entire SU protein and a portion of the TM protein including the fusion domain, but lacking the transmembrane domain. Regions important for oligomer formation may be partially functional. Heptad(H) 1, Heptad 2 and their Interspace(IS) are required for oligomerization. The expression vector backbone is pVR1012x/s (VRC2000).

VRC2707 pVR1012x/s X4gp145(del F/CL del H IS)/h

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, and P470L. The full-length X4-tropic version of the envelope protein from pX4gp160/h (VRC3300) was terminated after the codon for amino acid 704. The truncated envelope polyprotein contains the entire SU protein and a portion of the TM protein including the fusion domain, but lacking the transmembrane domain. Regions important for oligomer formation may be partially functional. Heptad(H) 1, Heptad 2 and their Interspace(IS) are required for oligomerization. The Fusion and Cleavage (F/CL) domains, from amino acids 503-536, have been deleted. The Interspace (IS) between Heptad (H) 1 and 2, from amino acids 593-620, have been deleted. The expression vector backbone is pVR1012x/s (VRC2000).

VRC2800 pVR1012x/s R5gp140/h

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 680. The truncated envelope polyprotein contains the entire SU protein and a portion of the TM protein including the fusion domain, but lacking the transmembrane domain. Regions important for oligomer formation may be partially functional. The expression vector backbone is pVR1012x/s (VRC2000).

VRC2801 pVR1012x/s R5gp140(del F/CL del H IS)/h

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 680. The truncated envelope polyprotein contains the entire SU protein and a portion of the TM protein including the fusion domain, but lacking the transmembrane domain. Heptad(H) 1, Heptad 2 and their Interspace(IS) are required for oligomerization. The Fusion and Cleavage (F/CL) domains, from amino acids 503-536, have been deleted. The Interspace (IS) between Heptad (H) 1 and 2, from amino acids 593-620, have been deleted. Regions important for oligomer formation may be partially functional. The expression vector backbone is pVR1012x/s (VRC2000).

VRC2804 pVR1012x/s R5gp145/h

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, and P470L. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 704. The truncated envelope polyprotein (gp145) contains the entire SU protein and a portion of the TM protein including the fusion domain, the transmembrane domain, and regions important for oligomer formation. Heptad(H) 1, Heptad 2 and their Interspace (IS) are required for oligomerization. The expression vector backbone is pVR1012x/s (VRC2000).

VRC2805 pVR1012x/s R5gp145(del F/CL del H IS)/h

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, and P470L. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 704. The truncated envelope polyprotein (gp145) contains the entire SU protein and a portion of the TM protein including the fusion domain, the transmembrane domain, and regions important for oligomer formation. Heptad(H) 1, Heptad 2 and their Interspace (IS) are required for oligomerization. The Fusion and Cleavage (F/CL) domains, from amino acids 503-536, have been deleted. The Interspace (IS) between Heptad (H) 1 and 2, from amino acids 593-620, have been deleted. The expression vector backbone is pVR1012x/s (VRC2000).

VRC 2810 pVR1012x/s R5gp140delC1(delCFI)/h

Constant domain 1 was deleted from gp140delCFI from amino acid 33-127 and was replaced with a NheI site.

VRC 2811 pVR1012 x/s R5gp140delC2 (delCFI)/h

Constant domain 2 was deleted from gp140delCFI from amino acid 199-293, and was replaced with an NheI site

VRC2812 pVR1012x/s R5gp140delC3 (delCFI)/h

Constant domain 3 was deleted from gp140delCFI from amino acid 333-380, and was replaced with an NheI site.

VRC2813 pVR1012 x/s R5gp140delC4 (delCFI)/h

Constant domain 4 was deleted from gp140delCFI from amino acid 419-458, and was replaced with an NheI site.

VRC2814 pVR1012x/s R5gp140delC5 (delCFI)/h

Constant domain 5 was deleted from gp140delCFI from amino acid 472-498 and was replaced with an NheI site.

VRC 2820 pVR1012x/s R5gp140(dCFI)/dV1

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 680. The truncated envelope polyprotein contains the entire SU protein and a portion of the TM protein including the fusion domain, but lacking the V1 loop (a.a.129 to 154) and transmembrane domain. Heptad(H) 1, Heptad 2 and their Interspace(IS) are required for oligomerization. The Fusion and Cleavage (F/CL) domains, from amino acids 503-536, have been deleted. The Interspace (IS) between Heptad (H) 1 and 2, from amino acids 593-620, have been deleted. Regions important for oligomer formation may be partially functional. The expression vector backbone is pVR1012x/s (VRC2000).

VRC 2821 pVR1012x/s R5gp140(dCFI)/dV2

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 680. The truncated envelope polyprotein contains the entire SU protein and a portion of the TM protein including the fusion domain, but lacking the V2 loop (a.a.160 to 193) and transmembrane domain. Heptad(H) 1, Heptad 2 and their Interspace(IS) are required for oligomerization. The Fusion and Cleavage (F/CL) domains, from amino acids 503-536, have been deleted. The Interspace (IS) between Heptad (H) 1 and 2, from amino acids 593-620, have been deleted. Regions important for oligomer formation may be partially functional. The expression vector backbone is pVR1012x/s (VRC2000).

VRC 2822 pVR1012x/s R5gp140(dCFI)/dV3

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 680. The truncated envelope polyprotein contains the entire SU protein and a portion of the TM protein including the fusion domain, but lacking the V3 loop (a.a.299 to 327) and transmembrane domain. Heptad (H) 1, Heptad 2 and their Interspace(IS) are required for oligomerization. The Fusion and Cleavage (F/CL) domains, from amino acids 503-536, have been deleted. The Interspace (IS) between Heptad (H) 1 and 2, from amino acids 593-620, have been deleted. Regions important for oligomer formation may be partially functional. The expression vector backbone is pVR1012x/s (VRC2000).

VRC 2823 pVR1012x/s R5gp140(dCFI)/dV4

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 680. The truncated envelope polyprotein contains the entire SU protein and a portion of the TM protein including the fusion domain, but lacking the V4 loop (a.a.386 to 413) and transmembrane domain. Heptad (H) 1, Heptad 2 and their Interspace(IS) are required for oligomerization. The Fusion and Cleavage (F/CL) domains, from amino acids 503-536, have been deleted. The Interspace (IS) between Heptad (H) 1 and 2, from amino acids 593-620, have been deleted. Regions important for oligomer formation may be partially functional. The expression vector backbone is pVR1012x/s (VRC2000).

VRC 2824 pVR1012x/s R5gp140(dCFI)/dV12

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 680. The truncated envelope polyprotein contains the entire SU protein and a portion of the TM protein including the fusion domain, but lacking the V1, V2 loops (a.a.129 to 154, and a.a.160 to 193) and transmembrane domain. Heptad(H) 1, Heptad 2 and their Interspace(IS) are required for oligomerization. The Fusion and Cleavage (F/CL) domains, from amino acids 503-536, have been deleted. The Interspace (IS) between Heptad (H) 1 and 2, from amino acids 593-620, have been deleted. Regions important for oligomer formation may be partially functional. The expression vector backbone is pVR1012x/s (VRC2000).

VRC 2825 pVR1012x/s R5gp140(dCFI)/dV13

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 680. The truncated envelope polyprotein contains the entire SU protein and a portion of the TM protein including the fusion domain, but lacking the V1, V3 loops (a.a.129 to 154, and a.a.299 to 327) and transmembrane domain. Heptad (H) 1, Heptad 2 and their Interspace (IS) are required for oligomerization. The Fusion and Cleavage (F/CL) domains, from amino acids 503-536, have been deleted. The Interspace (IS) between Heptad (H) 1 and 2, from amino acids 593-620, have been deleted. Regions important for oligomer formation may be partially functional. The expression vector backbone is pVR1012x/s (VRC2000).

VRC 2826 pVR1012x/s R5gp140(dCFI)/dV14

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 680. The truncated envelope polyprotein contains the entire SU protein and a portion of the TM protein including the fusion domain, but lacking the V1, V4 loops (a.a.129 to 154, and a.a.386 to 413) and transmembrane domain. Heptad(H) 1, Heptad 2 and their Interspace(IS) are required for oligomerization. The Fusion and Cleavage (F/CL) domains, from amino acids 503-536, have been deleted. The Interspace (IS) between Heptad (H) 1 and 2, from amino acids 593-620, have been deleted. Regions important for oligomer formation may be partially functional. The expression vector backbone is pVR1012x/s (VRC2000).

VRC 2827 pVR1012x/s R5gp140(dCFI)/dV23

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 680. The truncated envelope polyprotein contains the entire SU protein and a portion of the TM protein including the fusion domain, but lacking the V2, V3 loops (a.a.160 to 193, and a.a.299 to 413) and transmembrane domain. Heptad(H) 1, Heptad 2 and their Interspace(IS) are required for oligomerization. The Fusion and Cleavage (F/CL) domains, from amino acids 503-536, have been deleted. The Interspace (IS) between Heptad (H) 1 and 2, from amino acids 593-620, have been deleted. Regions important for oligomer formation may be partially functional. The expression vector backbone is pVR1012x/s (VRC2000).

VRC 2828 pVR1012x/s R5gp140(dCFI)/dV24

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 680. The truncated envelope polyprotein contains the entire SU protein and a portion of the TM protein including the fusion domain, but lacking the V2, V4 loops (a.a.160 to 193, and a.a.386 to 413) and transmembrane domain. Heptad(H) 1, Heptad 2 and their Interspace(IS) are required for oligomerization. The Fusion and Cleavage (F/CL) domains, from amino acids 503-536, have been deleted. The Interspace (IS) between Heptad (H) 1 and 2, from amino acids 593-620, have been deleted. Regions important for oligomer formation may be partially functional. The expression vector backbone is pVR1012x/s (VRC2000).

VRC 2829 pVR1012x/s R5gp140(dCFI)/dV34

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 680. The truncated envelope polyprotein contains the entire SU protein and a portion of the TM protein including the fusion domain, but lacking the V3, V4 loops (a.a.299 to 327, and a.a.386 to 413) and transmembrane domain. Heptad(H) 1, Heptad 2 and their Interspace(IS) are required for oligomerization. The Fusion and Cleavage (F/CL) domains, from amino acids 503-536, have been deleted. The Interspace (IS) between Heptad (H) 1 and 2, from amino acids 593-620, have been deleted. Regions important for oligomer formation may be partially functional. The expression vector backbone is pVR1012x/s (VRC2000).

VRC 2830 pVR1012x/s R5gp140(dCFI)/dV123

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 680. The truncated envelope polyprotein contains the entire SU protein and a portion of the TM protein including the fusion domain, but lacking the V1, V2, V3 loops (a.a.129 to 154, a.a.160 to 193, and a.a.299 to 327) and transmembrane domain. Heptad(H) 1, Heptad 2 and their Interspace(IS) are required for oligomerization. The Fusion and Cleavage (F/CL) domains, from amino acids 503-536, have been deleted. The Interspace (IS) between Heptad (H) 1 and 2, from amino acids 593-620, have been deleted. Regions important for oligomer formation may be partially functional. The expression vector backbone is pVR1012x/s (VRC2000).

VRC 2831 pVR1012x/s R5gp140(dCFI)/dV124

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 680. The truncated envelope polyprotein contains the entire SU protein and a portion of the TM protein including the fusion domain, but lacking the V1, V2, V4 loops (a.a.129 to 154, a.a.160 to 193, and a.a.386 to 413) and transmembrane domain. Heptad (H) 1, Heptad 2 and their Interspace (IS) are required for oligomerization. The Fusion and Cleavage (F/CL) domains, from amino acids 503-536, have been deleted. The Interspace (IS) between Heptad (H) 1 and 2, from amino acids 593-620, have been deleted. Regions important for oligomer formation may be partially functional. The expression vector backbone is pVR1012x/s (VRC2000).

VRC 2832 pVR1012x/s R5gp140(dCFI)/dV134

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 680. The truncated envelope polyprotein contains the entire SU protein and a portion of the TM protein including the fusion domain, but lacking the V1, V3, V4 loops (a.a.129 to 154, a.a.299 to 327, and a.a.386 to 413) and transmembrane domain. Heptad(H) 1, Heptad 2 and their Interspace(IS) are required for oligomerization. The Fusion and Cleavage (F/CL) domains, from amino acids 503-536, have been deleted. The Interspace (IS) between Heptad (H) 1 and 2, from amino acids 593-620, have been deleted. Regions important for oligomer formation may be partially functional. The expression vector backbone is pVR1012x/s (VRC2000).

VRC 2833 pVR1012x/s R5gp140(dCFI)/dV234

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 680. The truncated envelope polyprotein contains the entire SU protein and a portion of the TM protein including the fusion domain, but lacking the V2, V3, V4 loops (a.a.160 to 193, a.a.299 to 327, and a.a.386 to 413) and transmembrane domain. Heptad(H) 1, Heptad 2 and their Interspace(IS) are required for oligomerization. The Fusion and Cleavage (F/CL) domains, from amino acids 503-536, have been deleted. The Interspace (IS) between Heptad (H) 1 and 2, from amino acids 593-620, have been deleted. Regions important for oligomer formation may be partially functional. The expression vector backbone is pVR1012x/s (VRC2000).

VRC 2834 pVR1012x/s R5gp140(dCFI)/dV1234

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 680. The truncated envelope polyprotein contains the entire SU protein and a portion of the TM protein including the fusion domain, but lacking the V1, V2, V3, V4 loops (a.a.129 to 154, a.a.160 to 193, a.a.299 to 327, and a.a.386 to 413) and transmembrane domain. Heptad(H) 1, Heptad 2 and their Interspace(IS) are required for oligomerization. The Fusion and Cleavage (F/CL) domains, from amino acids 503-536, have been deleted. The Interspace (IS) between Heptad (H) 1 and 2, from amino acids 593-620, have been deleted.

Regions important for oligomer formation may be partially functional. The expression vector backbone is pVR1012x/s (VRC2000).

VRC 2835 pAdApt R5gp140(dCFI)/dV1

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 680. The truncated envelope polyprotein contains the entire SU protein and a portion of the TM protein including the fusion domain, but lacking the V1 loop (a.a.129 to 154) and transmembrane domain. Heptad(H) 1, Heptad 2 and their Interspace(IS) are required for oligomerization. The Fusion and Cleavage (F/CL) domains, from amino acids 503-536, have been deleted. The Interspace (IS) between Heptad (H) 1 and 2, from amino acids 593-620, have been deleted. Regions important for oligomer formation may be partially functional. The expression vector backbone is pAdApt.

VRC 2836 pAdApt R5gp140(dCFI)/dV2

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 680. The truncated envelope polyprotein contains the entire SU protein and a portion of the TM protein including the fusion domain, but lacking the V2 loop (a.a.160 to 193) and transmembrane domain. Heptad(H) 1, Heptad 2 and their Interspace(IS) are required for oligomerization. The Fusion and Cleavage (F/CL) domains, from amino acids 503-536, have been deleted. The Interspace (IS) between Heptad (H) 1 and 2, from amino acids 593-620, have been deleted. Regions important for oligomer formation may be partially functional. The expression vector backbone is AdApt.

VRC 2837 pAdApt R5gp140(dCFI)/dV3

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 680. The truncated envelope polyprotein contains the entire SU protein and a portion of the TM protein including the fusion domain, but lacking the V3 loop (a.a.299 to 327) and transmembrane domain. Heptad (H) 1, Heptad 2 and their Interspace(IS) are required for oligomerization. The Fusion and Cleavage (F/CL) domains, from amino acids 503-536, have been deleted. The Interspace (IS) between Heptad (H) 1 and 2, from amino acids 593-620, have been deleted. Regions important for oligomer formation may be partially functional. The expression vector backbone is pAdApt.

VRC 2838 pAdApt R5gp140(dCFI)/dV4

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 680. The truncated envelope polyprotein contains the entire SU protein and a portion of the TM protein including the fusion domain, but lacking the V4 loop (a.a.386 to 413) and transmembrane domain. Heptad (H) 1, Heptad 2 and their Interspace(IS) are required for oligomerization. The Fusion and Cleavage (F/CL) domains, from amino acids 503-536, have been deleted. The Interspace (IS) between Heptad (H) 1 and 2, from amino acids 593-620, have been deleted. Regions important for oligomer formation may be partially functional. The expression vector backbone is pAdApt.

VRC 2839 pAdApt R5gp140(dCFI)/dV12

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 680. The truncated envelope polyprotein contains the entire SU protein and a portion of the TM protein including the fusion domain, but lacking the V1, V2 loops (a.a.129 to 154, and a.a.160 to 193) and transmembrane domain. Heptad(H) 1, Heptad 2 and their Interspace(IS) are required for oligomerization. The Fusion and Cleavage (F/CL) domains, from amino acids 503-536, have been deleted. The Interspace (IS) between Heptad (H) 1 and 2, from amino acids 593-620, have been deleted. Regions important for oligomer formation may be partially functional. The expression vector backbone is pAdApt.

VRC 2840 pAdApt R5gp140(dCFI)/dV13

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 680. The truncated envelope polyprotein contains the entire SU protein and a portion of the TM protein including the fusion domain, but lacking the V1, V3 loops (a.a.129 to 154, and a.a.299 to 327) and transmembrane domain. Heptad (H) 1, Heptad 2 and their Interspace (IS) are required for oligomerization. The Fusion and Cleavage (F/CL) domains, from amino acids 503-536, have been deleted. The Interspace (IS) between Heptad (H) 1 and 2, from amino acids 593-620, have been deleted. Regions important for oligomer formation may be partially functional. The expression vector backbone is pAdApt.

VRC 2841 pAdApt R5gp140(dCFI)/dV14

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 680. The truncated envelope polyprotein contains the entire SU protein and a portion of the TM protein including the fusion domain, but lacking the V1, V4 loops (a.a.129 to 154, and a.a.386 to 413) and transmembrane domain. Heptad(H) 1, Heptad 2 and their Interspace(IS) are required for oligomerization. The Fusion and Cleavage (F/CL) domains, from amino acids 503-536, have been deleted. The Interspace (IS) between Heptad (H) 1 and 2, from amino acids 593-620, have been deleted. Regions important for oligomer formation may be partially functional. The expression vector backbone is pAdApt.

VRC 2842 pAdApt R5gp140(dCFI)/dV23

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 680. The truncated envelope polyprotein contains the entire SU protein and a portion of the TM protein including the fusion domain, but lacking the V2, V3 loops (a.a.160 to 193, and a.a.299 to 413) and transmembrane domain. Heptad(H) 1, Heptad 2 and their Interspace(IS) are required for oligomerization. The Fusion and Cleavage (F/CL) domains, from amino acids 503-536, have been deleted. The Interspace (IS) between Heptad (H) 1 and 2, from amino acids 593-620, have been deleted. Regions important for oligomer formation may be partially functional. The expression vector backbone is pAdApt.

VRC 2843 pAdApt R5gp140(dCFI)/dV24

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 680. The truncated envelope polyprotein contains the entire SU protein and a portion of the TM protein including the fusion domain, but lacking the V2, V4 loops (a.a.160 to 193, and a.a.386 to 413) and transmembrane domain. Heptad(H) 1, Heptad 2 and their Interspace(IS) are required for oligomerization. The Fusion and Cleavage (F/CL) domains, from amino acids 503-536, have been deleted. The Interspace (IS) between Heptad (H) 1 and 2, from amino acids 593-620, have been deleted. Regions important for oligomer formation may be partially functional. The expression vector backbone is pAdApt.

VRC 2844 pAdApt R5gp140(dCFI)/dV34

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 680. The truncated envelope polyprotein contains the entire SU protein and a portion of the TM protein including the fusion domain, but lacking the V3, V4 loops (a.a.299 to 327, and a.a.386 to 413) and transmembrane domain. Heptad(H) 1, Heptad 2 and their Interspace(IS) are required for oligomerization. The Fusion and Cleavage (F/CL) domains, from amino acids 503-536, have been deleted. The Interspace (IS) between Heptad (H) 1 and 2, from amino acids 593-620, have been deleted. Regions important for oligomer formation may be partially functional. The expression vector backbone is pAdApt.

VRC 2845 pAdApt R5gp140(dCFI)/dV123

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 680. The truncated envelope polyprotein contains the entire SU protein and a portion of the TM protein including the fusion domain, but lacking the V1, V2, V3 loops (a.a.129 to 154, a.a.160 to 193, and a.a.299 to 327) and transmembrane domain. Heptad(H) 1, Heptad 2 and their Interspace(IS) are required for oligomerization. The Fusion and Cleavage (F/CL) domains, from amino acids 503-536, have been deleted. The Interspace (IS) between Heptad (H) 1 and 2, from amino acids 593-620, have been deleted. Regions important for oligomer formation may be partially functional. The expression vector backbone is pAdApt

VRC 2846 pAdApt R5gp140(dCFI)/dV124

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 680. The truncated envelope polyprotein contains the entire SU protein and a portion of the TM protein including the fusion domain, but lacking the V1, V2, V4 loops (a.a.129 to 154, a.a.160 to 193, and a.a.386 to 413) and transmembrane domain. Heptad (H) 1, Heptad 2 and their Interspace (IS) are required for oligomerization. The Fusion and Cleavage (F/CL) domains, from amino acids 503-536, have been deleted. The Interspace (IS) between Heptad (H) 1 and 2, from amino acids 593-620, have been deleted. Regions important for oligomer formation may be partially functional. The expression vector backbone is pAdApt.

VRC 2847 pAdApt R5gp140(dCFI)/dV134

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 680. The truncated envelope polyprotein contains the entire SU protein and a portion of the TM protein including the fusion domain, but lacking the V1, V3, V4 loops (a.a.129 to 154, a.a.299 to 327, and a.a.386 to 413) and transmembrane domain. Heptad(H) 1, Heptad 2 and their Interspace(IS) are required for oligomerization. The Fusion and Cleavage (F/CL) domains, from amino acids 503-536, have been deleted. The Interspace (IS) between Heptad (H) 1 and 2, from amino acids 593-620, have been deleted. Regions important for oligomer formation may be partially functional. The expression vector backbone is pAdApt.

VRC 2848 pAdApt R5gp140(dCFI)/dV234

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 680. The truncated envelope polyprotein contains the entire SU protein and a portion of the TM protein including the fusion domain, but lacking the V2, V3, V4 loops (a.a.160 to 193, a.a.299 to 327, and a.a.386 to 413) and transmembrane domain. Heptad(H) 1, Heptad 2 and their Interspace(IS) are required for oligomerization. The Fusion and Cleavage (F/CL) domains, from amino acids 503-536, have been deleted. The Interspace (IS) between Heptad (H) 1 and 2, from amino acids 593-620, have been deleted. Regions important for oligomer formation may be partially functional. The expression vector backbone is pAdApt.

VRC 2849 pAdApt R5gp140(dCFI)/dV1234

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 680. The truncated envelope polyprotein contains the entire SU protein and a portion of the TM protein including the fusion domain, but lacking the V1, V2, V3, V4 loops (a.a.129 to 154, a.a.160 to 193, a.a.299 to 327, and a.a.386 to 413) and transmembrane domain. Heptad(H) 1, Heptad 2 and their Interspace(IS) are required for oligomerization. The Fusion and Cleavage (F/CL) domains, from amino acids 503-536, have been deleted. The Interspace (IS) between Heptad (H) 1 and 2, from amino acids 593-620, have been deleted. Regions important for oligomer formation may be partially functional. The expression vector backbone is pAdApt.

VRC2850 pVR1012 x/s R5gp145delC1 (delCFI)/h

Constant domain 1 was deleted from gp145delCFI from amino acid 33-127 and was replaced with an Nhe I site.

VRC2851 pVR1012 x/s R5gp145delC2 (delCFI)/h

Constant domain 2 was deleted from gp145dCFI from amino acid 199-293 and was replaced with an Nhe I site.

VRC2852 pVR1012 x/s R5gp145delC3 (delCFI)/h

Constant domain 3 was deleted from gp145delCFI from amino acid 333-380 and was replaced with an Nhe I site.

VRC2853 pVR1012 x/s R5gp145delC4 (delCFI)/h

Constant domain 4 was deleted from gp145delCFI from amino acid 419-458 and was replaced with an Nhe I site.

VRC2854 pVR1012x/s R5gp145delC5 (delCFI)/h

Constant domain 5 was deleted from gp145delCFI from amino acid 472-498 and was replaced with an Nhe I site.

VRC 2860 pVR1012x/s R5gp145(dCFI)/h/dV1

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, and P470L. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 704. The truncated envelope polyprotein (gp145) contains the entire SU protein and a portion of the TM protein including the fusion domain, the transmembrane domain, and regions important for oligomer formation. Heptad(H) 1, Heptad 2 and their Interspace (IS) are required for oligomerization. The V1 loop (a.a.129-154) and Fusion and Cleavage (F/CL) domains (a.a.503-536) have been deleted. Also, the Interspace (IS) between Heptad (H) 1 and 2 (a.a.593-620) have been deleted. The expression vector backbone is pVR1012x/s (VRC2000).

VRC 2861 pVR1012x/s R5gp145(dCFI)/h/dV2

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, and P470L. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 704. The truncated envelope polyprotein (gp145) contains the entire SU protein and a portion of the TM protein including the fusion domain, the transmembrane domain, and regions important for oligomer formation. Heptad(H) 1, Heptad 2 and their Interspace (IS) are required for oligomerization. The V2 loop (a.a.160-

193) and Fusion and Cleavage (F/CL) domains (a.a.503-536) have been deleted. Also, the Interspace (IS) between Heptad (H) 1 and 2 (a.a.593-620) have been deleted. The expression vector backbone is pVR1012x/s (VRC2000).

VRC 2862 pVR1012x/s R5gp145(dCFI)/h/dV3

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, and P470L. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 704. The truncated envelope polyprotein (gp145) contains the entire SU protein and a portion of the TM protein including the fusion domain, the transmembrane domain, and regions important for oligomer formation. Heptad (H) 1, Heptad 2 and their Interspace (IS) are required for oligomerization. The V3 loop (a.a.299-327) and Fusion and Cleavage (F/CL) domains (a.a.503-536) have been deleted. Also, the Interspace (IS) between Heptad (H) 1 and 2 (a.a.593-620) have been deleted. The expression vector backbone is pVR1012x/s (VRC2000).

VRC 2863 pVR1012x/s R5gp145(dCFI)/h/dV4

The protein sequence of the envelope polyprotein (gp160) from HXB2. (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, and P470L. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 704. The truncated envelope polyprotein (gp145) contains the entire SU protein and a portion of the TM protein including the fusion domain, the transmembrane domain, and regions important for oligomer formation. Heptad (H) 1, Heptad 2 and their Interspace (IS) are required for oligomerization. The V4 loop (a.a.386-413) and Fusion and Cleavage (F/CL) domains (a.a.503-536) have been deleted. Also, the Interspace (IS) between Heptad (H) 1 and 2 (a.a.593-620) have been deleted. The expression vector backbone is pVR1012x/s (VRC2000).

VRC 2864 pVR1012x/s R5gp145(dCFI)/h/dV12

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, and P470L. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 704. The truncated envelope polyprotein (gp145) contains the entire SU protein and a portion of the TM protein including the fusion domain, the transmembrane domain, and regions important for oligomer formation. Heptad(H) 1, Heptad 2 and their Interspace (IS) are required for oligomerization. The V1, V2 loops (a.a.129-154 and 160-193) and Fusion and Cleavage (F/CL) domains (a.a.503-536) have been deleted. Also, the Interspace (IS) between Heptad (H) 1 and 2 (a.a.593-620) have been deleted. The expression vector backbone is pVR1012x/s (VRC2000).

VRC 2865 pVR1012x/s R5gp145(dCFI)/h/dV13

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, and P470L. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 704. The truncated envelope polyprotein (gp145) contains the entire SU protein and a portion of the TM protein including the fusion domain, the transmembrane domain, and regions important for oligomer formation. Heptad (H) 1, Heptad 2 and their Interspace (IS) are required for oligomerization. The V1, V3 loops (a.a.129-154 and 299-327) and Fusion and Cleavage (F/CL) domains (a.a.503-536) have been deleted. Also, the Interspace (IS) between Heptad (H) 1 and 2 (a.a.593-620) have been deleted. The expression vector backbone is pVR1012x/s (VRC2000).

VRC 2866 pVR1012x/s R5gp145(dCFI)/h/dV14

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, and P470L. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 704. The truncated envelope polyprotein (gp145) contains the entire SU protein and a portion of the TM protein including the fusion domain, the transmembrane domain, and regions important for oligomer formation. Heptad (H) 1, Heptad 2 and their Interspace (IS) are required for oligomerization. The V1, V4 loops (a.a.129-154 and 386-413) and Fusion and Cleavage (F/CL) domains (a.a.503-536) have been deleted. Also, the Interspace (IS) between Heptad (H) 1 and 2 (a.a.593-620) have been deleted. The expression vector backbone is pVR1012x/s (VRC2000).

VRC 2867 pVR1012x/s R5gp145(dCFI)/h/dV23

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, and P470L. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 704. The truncated envelope polyprotein (gp145) contains the entire SU protein and a portion of the TM protein including the fusion domain, the transmembrane domain, and regions important for oligomer formation. Heptad(H) 1, Heptad 2 and their Interspace (IS) are required for oligomerization. The V2, V3 loops (a.a.160-193 and 299-327) and Fusion and Cleavage (F/CL) domains (a.a.503-536) have been deleted. Also, the Interspace (IS) between Heptad (H) 1 and 2 (a.a.593-620) have been deleted. The expression vector backbone is pVR1012x/s (VRC2000).

VRC 2868 pVR1012x/s R5gp145(dCFI)/h/dV24

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, and P470L. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 704. The truncated envelope polyprotein (gp145) contains the entire SU protein and a portion of the TM protein including the fusion domain, the transmembrane domain, and regions important for oligomer formation. Heptad(H) 1, Heptad 2 and their Interspace (IS) are required for oligomerization. The V2, V4 loops (a.a.160-193 and 386-413) and Fusion and Cleavage (F/CL) domains (a.a.503-536) have been deleted. Also, the Interspace (IS) between Heptad (H) 1 and 2 (a.a.593-620) have been deleted. The expression vector backbone is pVR1012x/s (VRC2000).

VRC 2869 pVR1012x/s R5gp145(dCFI)/h/dV34

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, and P470L. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 704. The truncated envelope polyprotein (gp145) contains the entire SU protein and a portion of the TM protein including the fusion domain, the transmembrane domain, and regions important for oligomer formation. Heptad (H) 1, Heptad 2 and their Interspace (IS) are required for oligomerization. The V3, V4 loops (a.a.299-327 and 386-413) and Fusion and Cleavage (F/CL) domains (a.a.503-536) have been deleted. Also, the Interspace (IS) between Heptad (H) 1 and 2 (a.a.593-620) have been deleted. The expression vector backbone is pVR1012x/s (VRC2000).

VRC 2870 pVR1012x/s R5gp145(dCFI)/h/dV134

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, and P470L. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 704. The truncated envelope polyprotein (gp145) contains the entire SU protein and a portion of the TM protein including the fusion domain, the transmembrane domain, and regions important for oligomer formation. Heptad (H) 1, Heptad 2 and their Interspace (IS) are required for oligomerization. The V1, V3, V4 loops (a.a.129-154, 299-327 and 386-413) and Fusion and Cleavage (F/CL) domains (a.a.503-536) have been deleted. Also, the Interspace (IS) between Heptad (H) 1 and 2 (a.a.593-620) have been deleted. The expression vector backbone is pVR1012x/s (VRC2000).

VRC 2871 pVR1012x/s R5gp145(dCFI)/h/dV234

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, and P470L. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 704. The truncated envelope polyprotein (gp145) contains the entire SU protein and a portion of the TM protein including the fusion domain, the transmembrane domain, and regions important for oligomer formation. Heptad (H) 1, Heptad 2 and their Interspace (IS) are required for oligomerization. The V2, V3, V4 loops (a.a.160-193, 299-327 and 386-413) and Fusion and Cleavage (F/CL) domains (a.a.503-536) have been deleted. Also, the Interspace (IS) between Heptad (H) 1 and 2 (a.a.593-620) have been deleted. The expression vector backbone is pVR1012x/s (VRC2000).

VRC 2872 pVR1012x/s R5gp145(dCFI)dv123/h

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, and P470L. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 704. The truncated envelope polyprotein (gp145) contains the entire SU protein and a portion of the TM protein including the fusion domain, the transmembrane domain, and regions important for oligomer formation. Heptad (H) 1, Heptad 2 and their Interspace (IS) are required for oligomerization. The V1, V2, V4 loops (a.a.129-154, 160-193 and 386-413) and Fusion and Cleavage (F/CL) domains (a.a.503-536) have been deleted. Also, the Interspace (IS) between Heptad (H) 1 and 2 (a.a.593-620) have been deleted. The expression vector backbone is pVR1012x/s (VRC2000).

VRC 2873 pVR1012x/s R5gp145(dCFI)/h/dV124

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, and P470L. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 704. The truncated envelope polyprotein (gp145) contains the entire SU protein and a portion of the TM protein including the fusion domain, the transmembrane domain, and regions important for oligomer formation. Heptad (H) 1, Heptad 2 and their Interspace (IS) are required for oligomerization. The V1, V2, V4 loops (a.a.129-154, 160-193 and 386-413) and Fusion and Cleavage (F/CL) domains (a.a.503-536) have been deleted. Also, the Interspace (IS) between Heptad (H) 1 and 2 (a.a.593-620) have been deleted. The expression vector backbone is pVR1012x/s (VRC2000).

VRC 2874 pVR1012x/s R5gp145(dCFI)/h/dV1234

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, and P470L. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 704. The truncated envelope polyprotein (gp145) contains the entire SU protein and a portion of the TM protein including the fusion domain, the transmembrane domain, and regions important for oligomer formation. Heptad (H) 1, Heptad 2 and their Interspace (IS) are required for oligomerization. The V1, V2, V3, V4 loops (a.a. 129-154, 160-193, 299-327 and 386-413) and Fusion and Cleavage (F/CL) domains (a.a. 503-536) have been deleted. Also, the Interspace (IS) between Heptad (H) 1 and 2 (a.a.593-620) have been deleted. The expression vector backbone is pVR1012x/s (VRC2000).

VRC2900 pVR1012x/s R5gp150/h

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000) was terminated after the codon for amino acid 752. The truncated envelope polyprotein (gp150) contains the entire SU protein and a portion of the TM protein including the fusion domain, the transmembrane domain, and regions important for oligomer formation. The expression vector backbone is pVR1012x/s (VRC2000).

VRC3000 pVR1012x/s R5gp160/h

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). Full length SU and TM proteins are expressed from the pVR1012x/s (VRC2000) vector backbone.

VRC3200 pVR1012x/s X4gp150/h

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. The full-length X4-tropic version of the envelope protein gene from pX4gp160/h (VRC3300) was terminated after the codon for amino acid 752. The truncated envelope polyprotein (gp150) contains the entire SU protein and a portion of the TM protein including the fusion domain, the transmembrane domain, and regions important for oligomer formation. The expression vector backbone is pVR1012x/s (VRC2000).

VRC3201 pVR1012x/s X4gp150(del F/CL del H IS)/h

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. The full-length X4-tropic version of the envelope protein gene from pX4gp160/h (VRC3300) was terminated after the codon for amino acid 752. The truncated envelope polyprotein (gp150) contains the entire SU protein and a portion of the TM protein including the fusion domain, the transmembrane domain, and regions important for oligomer formation. Heptad(H) 1, Heptad 2 and their Interspace(IS) are required for oligomerization. The Fusion and Cleavage (F/CL) domains, from amino acids 503-536, have been deleted. The Interspace (IS) between Heptad (H) 1 and 2, from amino acids 593-620, have been deleted. The expression vector backbone is pVR1012x/s (VRC2000).

VRC3202 pVR1012x/s X4gp150 Δgly/h.

Eukaryotic vector with humanized codons expressing the HIV envelope glycoprotein gp150 from HXB2, X4 tropic mutated in the Glycosylation sites. VRC3202 pVR1012x/s X4gp150Dgly/h The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To disrupt potential glycosylation sites in the HIV-1 envelope proteins, point mutations were introduced into the full-length X4-tropic version of the envelope protein gene from pX4gp160/h (VRC3300). The resulting amino acids substitutions in X4gp160Dgly/h are: N88D, N156D, N160D, N197E, N230D, N234D, N241D, N276D, L288V, N289D, S291T, N295D, N332D, N339D, N356D, N386D, and N448D. The full-length X4-tropic version of the envelope protein gene from pX4gp160/h (VRC3300) was terminated after the codon for amino acid 752. Heptad(H) 1, Heptad 2 and their Interspace(IS) are required for oligomerization. Full length SU and TM proteins are expressed from the pVR1012x/s (VRC2000) vector backbone.

VRC3203 pVR1012x/s X4gp150 AB Δgly/h

The protein sequence of the envelope polyprotein (gp160) from HXB2 (X4-tropic, GenBank accession number K03455) was used to create a synthetic version of the gene (X4gp160/h) using codons optimized for expression in human cells. The AB designation means the amino acids from 1-307 (XbaI to EcoRI). The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To disrupt potential glycoslylation sites in the HIV-1 envelope proteins, point mutations were introduced into the full-length X4-tropic version of the envelope protein gene from pX4gp160/h (VRC3300). The resulting amino acids substitutions in X4gp160Dgly/h are: N88D, N156D, N160D, N197E, N230D, N234D, N241D, N276D, L288V, N289D, S291T, and N295D. The full-length X4-tropic version of the envelope protein gene from pX4gp160/h (VRC3300) was terminated after the codon for amino acid 752. Heptad(H) 1, Heptad 2 and their Interspace (IS) are required for oligomerization. Full length SU and TM proteins are expressed from the pVR1012x/s (VRC2000) vector backbone.

VRC3300 pVR1012x/s X4gp160/h

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. Heptad(H) 1, Heptad 2 and their Interspace(IS) are required for oligomerization. Full length SU and TM proteins are expressed from the pVR1012x/s (VRC2000) vector backbone.

VRC3301 pVR1012x/s X4gp160(del F/CL del H IS)/h

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. Full length SU and TM proteins are Expressed. Heptad(H) 1, Heptad 2 and their Interspace(IS) are required for oligomerization. The Fusion and Cleavage (F/CL) domains, from amino acids 503-536, have been deleted. The Interspace (IS) between Heptad (H) 1 and 2, from amino acids 593-620, have been deleted. The expression vector backbone is pVR1012x/s (VRC2000).

VRC3400 pVR1012x/s X4gp160Δgly/h

The protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To disrupt potential glycosylation sites in the HIV-1 envelope proteins, point mutations were introduced into the full-length X4-tropic version of the envelope protein gene from pX4gp160/h (VRC3300). The resulting amino acids substitutions in X4gp160Dgly/h are: N88D, N156D, N160D, N197E, N230D, N234D, N241D, N276D, L288V, N289D, S291T, N295D, N332D, N339D, N356D, N386D, and N448D. Heptad(H) 1, Heptad 2 and their Interspace(IS) are required for oligomerization. Full length SU and TM proteins are expressed from the pVR1012x/s (VRC2000) vector backbone.

VRC3401 pVR1012x/s X4gp160AB mut Δgly/h

The protein sequence of the envelope polyprotein (gp160) from HXB2 (X4-tropic, GenBank accession number K03455) was used to create a synthetic version of the gene (X4gp160/h) using codons optimized for expression in human cells. The AB designation means the amino acids from 1-307 (XbaI to EcoRI). The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To disrupt potential glycoslylation sites in the HIV-1 envelope proteins, point mutations were introduced into the full-length X4-tropic version of the envelope protein gene from pX4gp160/h (VRC3300). The resulting amino acids substitutions in X4gp160Dgly/h are: N88D, N156D, N160D, N197E, N230D, N234D, N241D, N276D, L288V, N289D, S291T, and N295D. Heptad(H) 1, Heptad 2 and their Interspace(IS) are required for oligomerization. Full length SU and TM proteins are expressed from the pVR1012x/s (VRC2000) vector backbone.

VRC3500 pVR1012x/s Nef/h

The protein sequence of the Nef protein from HIV-1 PV22 (GenBank accession number K02083) was used to create a synthetic version of the Nef gene (Nef/h) using codons optimized for expression in human cells. The nucleotide sequence Nef/h shows little homology to the viral gene, but the protein encoded is the same. Nef/h is expressed from the pVR1012x/s (VRC2000) vector backbone.

VRC3600 pVR1012x/s NefDMHCDCD4/h

The protein sequence of the Nef protein from HIV-1 PV22 (GenBank accession number K02083) was used to create a synthetic version of the Nef gene (Nef/h) using codons optimized for expression in human cells. To disrupt the ability of Nef to limit both MHC class I and CD4 expression point mutations were introduced into the Nef gene from pNef/h (VRC3500). The resulting amino acids substitutions in pNefDMHCDCD4/h are: P69A, P72A, P75A, P78A, D174A and D175A. pNefDMHCDCD4/h is expressed from the pVR1012x/s (VRC2000) vector backbone.

VRC3700 pVR1012x/s NefDCD4/h

The protein sequence of the Nef protein from HIV-1 PV22 (GenBank accession number K02083) was used to create a synthetic version of the Nef gene (Nef/h) using codons optimized for expression in human cells. To disrupt the ability of Nef to limit CD4 expression, point mutations were introduced into the Nef gene from pNef/h (VRC3500). The resulting amino acids substitutions in pNefDCD/h are: D174A and D175A. pNefDCD4/h is expressed from the pVR1012x/s (VRC2000) vector backbone. VRC3700 pVR1012x/s NefDCD4/h The protein sequence of the Nef protein from HIV-1 PV22 (GenBank accession number K02083) was used to create a synthetic version of the Nef gene (Nef/h) using codons optimized for expression in human cells. To disrupt the ability of Nef to limit CD4 expression, point mutations were introduced into the Nef gene from pNef/h (VRC3500). The resulting amino acids substitutions in pNefDCD/h are: D174A and D175A. pNefDCD4/h is expressed from the pVR1012x/s (VRC2000) vector backbone.

VRC3800 pVR 1012x/s NefDMHC/h

The protein sequence of the Nef protein from HIV-1 PV22 (GenBank accession number K02083) was used to create a synthetic version of the Nef gene (Nef/h) using codons optimized for expression in human cells. To disrupt the ability of Nef to limit MHC class I expression, point mutations were introduced into the Nef gene from pNef/h (VRC3500). The resulting amino acids substitutions in pNefDMHC/h are: P69A, P72A, P75A, and P78A. pNefDMHC/h is expressed from the pVR1012x/s (VRC2000) vector backbone.

VRC5200 pVR1012x/s 89.6Pgp128(del F/CL)/h

The protein sequence of the envelope polyprotein (gp160) from 89.6P (Dual-tropic, GenBank accession number u89134/LOCUS:SIU89134) was used to create a synthetic version of the gene (89.6Pgp160/h) using codons optimized for expression in human cells. The nucleotide sequence 89.6Pgp160/h shows little homology to the 89.6P gene, but the protein encoded is the same. The full-length 89.6P, dual-tropic version of the envelope protein gene from 89.6P gp160/h (VRC3000) was terminated after the codon for amino acid 596. The truncated envelope polyprotein contains the entire SU protein and a portion of the TM protein including the fusion domain, but lacking the transmembrane domain. The Fusion and Cleavage (F/CL) domains, from amino acids 508-541, have been deleted. The expression vector backbone is pVR1012x/s (VRC2000).

VRC5201 pVR1012x/s 89.6Pgp140(del F/CL del H IS/h

The protein sequence of the envelope polyprotein (gp160) from 89.6P (dual-tropic, GenBank accession number u89134/locus SIU89134) was used to create a synthetic version of the gene (Dualtropic gp160/h) using codons optimized for expression in human cells. The nucleotide sequence dualtropic gp160/h shows little homology to the 89.6P gene, but the protein encoded is the same. The full-length 89.6P, dual-tropic version of the envelope protein gene was terminated after the codon for amino acid 683. The truncated envelope polyprotein contains the entire SU protein and a portion of the TM protein including the fusion domain, but lacking the transmembrane domain. Heptad(H) 1, Heptad 2 and their Interspace(IS) are required for oligomerization. The Fusion and Cleavage (F/CL) domains, from amino acids 508-541, have been deleted. The Interspace (IS) between Heptad (H) 1 and 2, from amino acids 597-625, have been deleted. Regions important for oligomer formation may be partially functional. The expression vector backbone is pVR1012x/s (VRC2000).

VRC5202 pVR1012x/s 89.6Pgp145(del F/CL del H IS/h

The protein sequence of the envelope polyprotein (gp160) from 89.6P (dual-tropic, GenBank accession number u89134/locus SIU89134) was used to create a synthetic version of the gene (Dualtropic gp160/h) using codons optimized for expression in human cells. The nucleotide sequence dualtropic gp160/h shows little homology to the 89.6P gene, but the protein encoded is the same. The full-length 89.6P, dual-tropic version of the envelope protein gene was terminated after the codon for amino acid 709. The truncated envelope polyprotein contains the entire SU protein and a portion of the TM protein including the fusion domain, but lacking the transmembrane domain. Heptad(H) 1, Heptad 2 and their Interspace(IS) are required for oligomerization. The Fusion and Cleavage (F/CL) domains, from amino acids 508-541, have been deleted. The Interspace (IS) between Heptad (H) 1 and 2, from amino acids 597-625, have been deleted. Regions important for oligomer formation may be partially functional. The expression vector backbone is pVR1012x/s (VRC2000).

VRC5203 pVR1012x/s 89.6Pgp160/h

The protein sequence of the envelope polyprotein (gp160) from 89.6P (Dual-tropic, GenBank accession number U89134/LOCUS: SIU89134) was used to create a synthetic version of the gene (dual tropic gp160/h) using codons optimized for expression in human cells. The nucleotide sequence 89.6P gp160/h shows little homology to the 89.6P gene, but the protein encoded is the same. Full length SU and TM proteins are expressed from the pVR1012x/s (VRC2000) vector backbone

VRC5300 pVR1012x/s R5(clade C)gp140(del F/CL del H IS)/h

The protein sequence of the envelope polyprotein (gp160) from 92br025 (R5-tropic, GenBank accession number U52953) was used to create a synthetic version of the gene (R5gp160/h) using codons optimized for expression in human cells. The nucleotide sequence R5gp160/h shows little homology to the 92br025 gene, but the protein encoded is the same. The full-length R5-tropic version of the envelope protein was synthesized by Operon under the name: kongene. The XbaI (18 nt up-stream from ATG) to BglII (1376 nt down-stream from ATG) fragment which contains polylinker at the 5' end, Kozak sequence and ATG was cloned into the XbaI to BglII sites of VRC2701 pVR1012x/s X4gp140(del F/CL del H IS)/h backbone. Therefore, the gene is R5 (clade C) gp160/h up to the BglII site (1376 nt from ATG) and the rest of the gene after BglII site is VRC2701 pVR102x/s X4gp140(del F/CL del H IS)/h. The truncated envelope polyprotein contains the entire SU protein and a portion of the TM protein including the fusion domain, but lacking the transmembrane domain. Regions important for oligomer formation may be partially functional. Heptad(H) 1, Heptad 2 and their Interspace(IS) are required for oligomerization. The Fusion and Cleavage (F/CL) domains, from amino acids 503-536, have been deleted. The Interspace (IS) between Heptad (H) 1 and 2, from amino acids 593-620, have been deleted. The expression vector backbone is pVR1012x/s (VRC2000). The full-length X4-tropic version of the envelope protein from pX4gp160/h (VRC3300) was terminated after the codon for amino acid 680.

VRC5301 pVR1012x/s R5(clade C)gp145(del F/CL del H IS)/h

The protein sequence of the envelope polyprotein (gp160) from 92br025 (R5-tropic, GenBank accession number U52953) was used to create a synthetic version of the gene (R5gp160/h) using codons optimized for expression in human cells. The nucleotide sequence R5gp160/h shows little homology to the 92br025 gene, but the protein encoded is the same. The full-length R5-tropic version of the envelope protein was synthesized by Operon under the name: kongene. The XbaI (18 nt up-stream from ATG) to BglII (1376 nt down-stream from ATG) fragment which contains polylinker at the 5' end, Kozak sequence and ATG was cloned into the XbaI to BglII sites of VRC2701 pVR1012x/s X4gp140(del F/CL del H IS)/h backbone. Therefore, the gene is R5 (clade C) gp160/h up to the BglII site (1376 nt from ATG) and the rest of the gene after BglII site is VRC2707 pVR1012x/s X4gp145(del F/CL del H IS)/h. The truncated envelope polyprotein contains the entire SU protein and a portion of the TM protein including the fusion domain, but lacking the transmembrane domain. Regions important for oligomer formation may be partially functional. Heptad(H) 1, Heptad 2 and their Interspace(IS) are required for oligomerization. The Fusion and Cleavage (F/CL) domains, from amino acids 503-536, have been deleted. The Interspace (IS) between Heptad (H) 1 and 2, from amino acids 593-620, have been deleted. The expression vector backbone is pVR1012x/s (VRC2000). The full-length X4-tropic version of the envelope protein from pX4gp160/h (VRC3300) was terminated after the codon for amino acid 704.

VRC5303 pVR1012x/s R5gp145CladeC(Brazil) delCFI/h

Authentic Clade C unlike 5301 which is a hybrid between C and B.

VRC 5304 pVR1012x/s R5(clade A)gp140(del F/CL del H IS)/h

The protein sequence of the envelope polyprotein (gp160) from 92rw020 (R5-tropic, GenBank accession number U51283) was used to create a synthetic version of the gene (Clade-A gp145delCFI) using codons optimized for expression in human cells. The nucleotide sequence R5gp145delCFI shows little homology to the 92rw020 gene, but the protein encoded is the same. The XbaI (18 nt up-stream from ATG) to BamHI (1837 nt down-stream from ATG) fragment which contains polylinker at the 5' end, Kozak sequence and ATG was cloned into the XbaI to BamHI sites of pVR1012x/s backbone. The truncated envelope polyprotein contains the entire SU protein and the TM domain, but lacking the Fusion domain and Cytoplasmic domain. Regions important for oligomer formation may be partially functional. Heptad(H) 1, Heptad 2 and their Interspace(IS) are required for oligomerization. The Fusion and Cleavage (F/CL) domains, from amino acids 486-519, have been deleted. The Interspace (IS) between Heptad (H) 1 and 2, from amino acids 576-604, have been deleted. The expression vector backbone is pVR1012x/s (VRC2000).

VRC 5305 pVR1012x/s R5(clade A)gp145(del F/CL del H IS)/h

The protein sequence of the envelope polyprotein (gp160) from 92rw020 (R5-tropic, GenBank accession number U51283) was used to create a synthetic version of the gene (Clade-A gp145delCFI) using codons optimized for expression in human cells. The nucleotide sequence R5gp145delCFI shows little homology to the 92rw020 gene, but the protein encoded is the same. The XbaI (18 nt up-stream from ATG) to BamHI (1912 nt down-stream from ATG) fragment which contains polylinker at the 5' end, Kozak sequence and ATG was cloned into the XbaI to BamHI sites of pVR1012x/s backbone. The truncated envelope polyprotein contains the entire SU protein and the TM domain, but lacking the Fusion domain and Cytoplasmic domain. Regions important for oligomer formation may be partially functional. Heptad(H) 1, Heptad 2 and their Interspace(IS) are required for oligomerization. The Fusion and Cleavage (F/CL) domains, from amino acids 486-519, have been deleted. The Interspace (IS) between Heptad (H) 1 and 2, from amino acids 576-604, have been deleted. The expression vector backbone is pVR1012x/s (VRC2000).

VRC 5306 pVR1012x/s R5(clade E)gp140(del F/CL del H IS)/h

The protein sequence of the envelope polyprotein (gp140delCFI) from 93th966.8 (R5-tropic, GenBank accession number U08456) was used to create a synthetic version of the gene (Clade-C gp140delCFI) using codons optimized for expression in human cells. The nucleotide sequence R5gp140delCFI shows little homology to the gene 93th966.8, but the protein encoded is the same. The XbaI (18 nt up-stream from ATG) to BamHI (1856 nt down-stream from ATG) fragment which contains polylinker at the 5' end, Kozak sequence and ATG was cloned into the XbaI to BamHI sites of pVR1012x/s backbone. The truncated envelope polyprotein contains the entire SU protein and the TM domain, but lacking the Fusion domain and Cytoplasmic domain. Regions important for oligomer formation may be partially functional. Heptad(H) 1, Heptad 2 and their Interspace(IS) are required for oligomerization. The Fusion and Cleavage (F/CL) domains, from amino acids 497-530, have been deleted. The Interspace (IS) between Heptad (H) 1 and 2, from amino acids 588-613, have been deleted. The expression vector backbone is pVR1012x/s (VRC2000).

VRC 5307 pVR1012x/s R5(clade E)gp145(del F/CL del H IS)/h

The protein sequence of the envelope polyprotein (gp145delCFI) from 93th966.8 (R5-tropic, GenBank accession number U08456) was used to create a synthetic version of the gene (Clade-C gp145delCFI) using codons optimized for expression in human cells. The nucleotide sequence R5gp145delCFI shows little homology to the gene 93th966.8, but the protein encoded is the same. The XbaI (18 nt up-stream from ATG) to BamHI (1928 nt down-stream from ATG) fragment which contains polylinker at the 5' end, Kozak sequence and ATG was cloned into the XbaI to BamHI sites of pVR1012x/s backbone. The truncated envelope polyprotein contains the entire SU protein and the TM domain, but lacking the Fusion domain and Cytoplasmic domain. Regions important for oligomer formation may be partially functional. Heptad(H) 1, Heptad 2 and their Interspace(IS) are required for oligomerization. The Fusion and Cleavage (F/CL) domains, from amino acids 497-530, have been deleted. The Interspace (IS) between Heptad (H) 1 and 2, from amino acids 588-613, have been deleted. The expression vector backbone is pVR1012x/s (VRC2000).

VRC 5308 pVR1012x/s R5(clade C South African)gp140(del F/CL del H IS)/h

The protein sequence of the envelope polyprotein (gp140delCFI) from 97ZA012 (R5-tropic, GenBank accession number AF286227) was used to create a synthetic version of the gene (Clade-C gp145delCFI) using codons optimized for expression in human cells. The nucleotide sequence R5gp145delCFI shows little homology to the gene 97ZA012, but the protein encoded is the same. The XbaI (18 nt up-stream from ATG) to BamHI (1833 nt down-stream from ATG) fragment which contains polylinker at the 5' end, Kozak sequence and ATG was cloned into the XbaI to BamHI sites of pVR1012x/s backbone. The truncated envelope polyprotein contains the entire SU protein and the TM domain, but lacking the Fusion domain and Cytoplasmic domain. Regions important for oligomer formation may be partially functional. Heptad(H) 1, Heptad 2 and their Interspace(IS) are required for oligomerization. The Fusion and Cleavage (F/CL) domains, from amino acids 487-520, have been deleted. The Interspace (IS) between Heptad (H) 1 and 2, from amino acids 577-605, have been deleted. The expression vector backbone is pVR1012x/s (VRC2000).

VRC 5309 pVR1012x/s R5(clade C South African)gp145(del F/CL del H IS)/h

The protein sequence of the envelope polyprotein (gp145delCFI) from 97ZA012 (R5-tropic, GenBank accession number AF286227) was used to create a synthetic version of the gene (Clade-C gp145delCFI) using codons optimized for expression in human cells. The nucleotide sequence R5gp145delCFI shows little homology to the gene 97ZA012, but the protein encoded is the same. The XbaI (18 nt up-stream from ATG) to BamHI (1914 nt down-stream from ATG) fragment which contains polylinker at the 5' end, Kozak sequence and ATG was cloned into the XbaI to BamHI sites of pVR1012x/s backbone. The truncated envelope polyprotein contains the entire SU protein and the TM domain, but lacking the Fusion domain and Cytoplasmic domain. Regions important for oligomer formation may be partially functional. Heptad(H) 1, Heptad 2 and their Interspace(IS) are required for oligomerization. The Fusion and Cleavage (F/CL) domains, from amino acids 487-520, have been deleted. The Interspace (IS) between Heptad (H) 1 and 2, from amino acids 577-605, have been deleted. The expression vector backbone is pVR1012x/s (VRC2000).

VRC 5350 pVRC1012(x/s)-gp140(dCFI)(Brazil C)/dV1

The protein sequence of the envelope polyprotein (gp160) from 92BR025 (R5-tropic, GenBank accession number U52953) was used to create a synthetic version of the gene (Brazil-C gp140delCFI) using codons optimized for expression in human cells. The nucleotide sequence of Brazil-C gp140(delCFI) shows little homology to the gene 92BR025, but the protein encoded is the same. The XbaI (18 nt upstream from ATG) to BamHI (1910 nt down-stream from ATG) fragment which contains polylinker at the 5' end, Kozak sequence and ATG was cloned into the XbaI to BamHI sites of pVR1012x/s backbone. The truncated envelope polyprotein contains deletion in the V1 loop(a.a.133-148) of the SU protein. It also lacks the Fusion and Cleavage (F/CL) domains(a.a.496-529), the Interspace (IS) between Heptad (H) 1 and 2(a.a.586-612), transmembrane domain, and cytoplasmic domain in the TM protein. Regions important for oligomer formation may be partially functional. Heptad(H) 1, Heptad 2 and their Interspace(IS) are required for oligomerization. The expression vector backbone is pVR1012x/s (VRC2000).

VRC 5351 pVRC1012(x/s)-gp140(dCFI)(Brazil C)/dV12

The protein sequence of the envelope polyprotein (gp160) from 92BR025 (R5-tropic, GenBank accession number U52953) was used to create a synthetic version of the gene (Brazil-C gp140delCFI) using codons optimized for expression in human cells. The nucleotide sequence of Brazil-C gp140(delCFI) shows little homology to the gene 92BR025, but the protein encoded is the same. The XbaI (18 nt upstream from ATG) to BamHI (1910 nt down-stream from ATG) fragment which contains polylinker at the 5' end, Kozak sequence and ATG was cloned into the XbaI to BamHI sites of pVR1012x/s backbone. The truncated envelope polyprotein contains deletion in the V1,V2 loops (a.a.133-191) of the SU protein. It also lacks the Fusion and Cleavage (F/CL) domains(a.a.496-529), the Interspace (IS) between Heptad (H) 1 and 2(a.a.586-612), transmembrane domain, and cytoplasmic domain in the TM protein. Regions important for oligomer formation may be partially functional. Heptad(H) 1, Heptad 2 and their Interspace(IS) are required for oligomerization. The expression vector backbone is pVR1012x/s (VRC2000).

VRC 5352 pVRC1012(x/s)-gp140(dCFI)(Brazil C)/dV123

The protein sequence of the envelope polyprotein (gp160) from 92BR025 (R5-tropic, GenBank accession number U52953) was used to create a synthetic version of the gene (Brazil-C gp140delCFI) using codons optimized for expression in human cells. The nucleotide sequence of Brazil-C gp140(delCFI) shows little homology to the gene 92BR025, but the protein encoded is the same. The XbaI (18 nt upstream from ATG) to BamHI (1910 nt down-stream from ATG) fragment which contains polylinker at the 5' end, Kozak sequence and ATG was cloned into the XbaI to BamHI sites of pVR1012x/s backbone. The truncated envelope polyprotein contains deletion in the V1, V2, V3 loops (a.a.130-191, 330-358) of the SU protein. It also lacks the Fusion and Cleavage (F/CL) domains(a.a.496-529), the Interspace (IS) between Heptad (H) 1 and 2(a.a.586-612), transmembrane domain, and cytoplasmic domain in the TM protein. Regions important for oligomer formation may be partially functional. Heptad(H) 1, Heptad 2 and their Interspace(IS) are required for oligomerization. The expression vector backbone is pVR1012x/s (VRC2000).

VRC 5353 pVRC1012(x/s)-gp140(dCFI)(Brazil C)/dV1234

The protein sequence of the envelope polyprotein (gp160) from 92BR025 (R5-tropic, GenBank accession number U52953) was used to create a synthetic version of the gene (Brazil-C gp140delCFI) using codons optimized for expression in human cells. The nucleotide sequence of Brazil-C gp140(delCFI) shows little homology to the gene 92BR025, but the protein encoded is the same. The XbaI (18 nt upstream from ATG) to BamHI (1910 nt down-stream from ATG) fragment which contains polylinker at the 5' end, Kozak sequence and ATG was cloned into the XbaI to BamHI sites of pVR1012x/s backbone. The truncated envelope polyprotein contains deletion in the V1, V2, V3, V4 loops (a.a.130-191, 330-358, 384-408) of the SU protein. It also lacks the Fusion and Cleavage (F/CL) domains(a.a.496-529), the Interspace (IS) between Heptad (H) 1 and 2(a.a.586-612), transmembrane domain, and cytoplasmic domain in the TM protein. Regions important for oligomer formation may be partially functional. Heptad(H) 1, Heptad 2 and their Interspace(IS) are required for oligomerization. The expression vector backbone is pVR1012x/s (VRC2000).

VRC 5354 pVRC1012(x/s)-gp140(dCFI)(Brazil C)/dV124

The protein sequence of the envelope polyprotein (gp160) from 92BR025 (R5-tropic, GenBank accession number U52953) was used to create a synthetic version of the gene (Brazil-C gp140delCFI) using codons optimized for expression in human cells. The nucleotide sequence of Brazil-C gp140(delCFI) shows little homology to the gene 92BR025, but the protein encoded is the same. The XbaI (18 nt upstream from ATG) to BamHI (1910 nt down-stream from ATG) fragment which contains polylinker at the 5' end, Kozak sequence and ATG was cloned into the XbaI to BamHI sites of pVR1012x/s backbone. The truncated envelope polyprotein contains deletion in the V1, V2, V4 loops (a.a.130-191, 384-408) of the SU protein. It also lacks the Fusion and Cleavage (F/CL) domains(a.a.496-529), the Interspace (IS) between Heptad (H) 1 and 2(a.a.586-612), transmembrane domain, and cytoplasmic domain in the TM protein. Regions important for oligomer formation may be partially functional. Heptad(H) 1, Heptad 2 and their Interspace(IS) are required for oligomerization. The expression vector backbone is pVR1012x/s (VRC2000).

VRC 5355 pVRC1012(x/s)-gp140(dCFI)(Brazil C)/dV13

The protein sequence of the envelope polyprotein (gp160) from 92BR025 (R5-tropic, GenBank accession number U52953) was used to create a synthetic version of the gene (Brazil-C gp140delCFI) using codons optimized for expression in human cells. The nucleotide sequence of Brazil-C gp140(delCFI) shows little homology to the gene 92BR025, but the protein encoded is the same. The XbaI (18 nt upstream from ATG) to BamHI (1910 nt down-stream from ATG) fragment which contains polylinker at the 5' end, Kozak sequence and ATG was cloned into the XbaI to BamHI sites of pVR1012x/s backbone. The truncated envelope polyprotein contains deletion in the V1, V3 loops (a.a.133-148, 330-358) of the SU protein. It also lacks the Fusion and Cleavage (F/CL) domains(a.a.496-529), the Interspace (IS) between Heptad (H) 1 and 2(a.a.586-612), transmembrane domain, and cytoplasmic domain in the TM protein. Regions important for oligomer formation may be partially functional. Heptad(H) 1, Heptad 2 and their Interspace(IS) are required for oligomerization. The expression vector backbone is pVR1012x/s (VRC2000).

VRC 5356 pVRC1012(x/s)-gp140(dCFI)(Brazil C)/dV134

The protein sequence of the envelope polyprotein (gp160) from 92BR025 (R5-tropic, GenBank accession number U52953) was used to create a synthetic version of the gene (Brazil-C gp140delCFI) using codons optimized for expression in human cells. The nucleotide sequence of Brazil-C gp140(delCFI) shows little homology to the gene 92BR025, but the protein encoded is the same. The XbaI (18 nt upstream from ATG) to BamHI (1910 nt down-stream from ATG) fragment which contains polylinker at the 5' end, Kozak sequence and ATG was cloned into the XbaI to BamHI sites of pVR1012x/s backbone. The truncated envelope polyprotein contains deletion in the V1, V3, V4 loops (a.a.130-148, 330-358, 384-408) of the SU protein. It also lacks the Fusion and Cleavage (F/CL) domains(a.a. 496-529), the Interspace (IS) between Heptad (H) 1 and 2(a.a.586-612), transmembrane domain, and cytoplasmic domain in the TM protein. Regions important for oligomer formation may be partially functional. Heptad(H) 1, Heptad 2 and their Interspace(IS) are required for oligomerization. The expression vector backbone is pVR1012x/s (VRC2000).

VRC 5357 pVRC1012(x/s)-gp140(dCFI)(Brazil C)/dV14

The protein sequence of the envelope polyprotein (gp160) from 92BR025 (R5-tropic, GenBank accession number U52953) was used to create a synthetic version of the gene (Brazil-C gp140delCFI) using codons optimized for expression in human cells. The nucleotide sequence of Brazil-C gp140(delCFI) shows little homology to the gene 92BR025, but the protein encoded is the same. The XbaI (18 nt upstream from ATG) to BamHI (1910 nt down-stream from ATG) fragment which contains polylinker at the 5' end, Kozak sequence and ATG was cloned into the XbaI to BamHI sites of pVR1012x/s backbone. The truncated envelope polyprotein contains deletion in the V1, V4 loops (a.a.130-148, 384-408) of the SU protein. It also lacks the Fusion and Cleavage (F/CL) domains(a.a.496-529), the Interspace (IS) between Heptad (H) 1 and 2(a.a.586-612), transmembrane domain, and cytoplasmic domain in the TM protein. Regions important for oligomer formation may be partially functional. Heptad(H) 1, Heptad 2 and their Interspace(IS) are required for oligomerization. The expression vector backbone is pVR1012x/s (VRC2000).

VRC 5358 pVRC1012(x/s)-gp140(dCFI)(Brazil C)/dV2

The protein sequence of the envelope polyprotein (gp160) from 92BR025 (R5-tropic, GenBank accession number U52953) was used to create a synthetic version of the gene (Brazil-C gp140delCFI) using codons optimized for expression in human cells. The nucleotide sequence of Brazil-C gp140(delCFI) shows little homology to the gene 92BR025, but the protein encoded is the same. The XbaI (18 nt upstream from ATG) to BamHI (1910 nt down-stream from ATG) fragment which contains polylinker at the 5' end, Kozak sequence and ATG was cloned into the XbaI to BamHI sites of pVR1012x/s backbone. The truncated envelope polyprotein contains deletion in the V2 loop(a.a.154-191) of the SU protein. It also lacks the Fusion and Cleavage (F/CL) domains(a.a.496-529), the Interspace (IS) between Heptad (H) 1 and 2(a.a.586-612), transmembrane domain, and cytoplasmic domain in the TM protein. Regions important for oligomer formation may be partially functional. Heptad(H) 1, Heptad 2 and their Interspace(IS) are required for oligomerization. The expression vector backbone is pVR1012x/s (VRC2000).

VRC 5359 pVRC1012(x/s)-gp140(dCFI)(Brazil C)/dV23

The protein sequence of the envelope polyprotein (gp160) from 92BR025 (R5-tropic, GenBank accession number U52953) was used to create a synthetic version of the gene (Brazil-C gp140delCFI) using codons optimized for expression in human cells. The nucleotide sequence of Brazil-C gp140(delCFI) shows little homology to the gene 92BR025, but the protein encoded is the same. The XbaI (18 nt upstream from ATG) to BamHI (1910 nt down-stream from ATG) fragment which contains polylinker at the 5' end, Kozak sequence and ATG was cloned into the XbaI to BamHI sites of pVR1012x/s backbone. The truncated envelope polyprotein contains deletion in the V2, V3 loops (a.a.154-191, 330-358) of the SU protein. It also lacks the Fusion and Cleavage (F/CL) domains(a.a.496-529), the Interspace (IS) between Heptad (H) 1 and 2(a.a.586-612), transmembrane domain, and cytoplasmic domain in the TM protein. Regions important for oligomer formation may be partially functional. Heptad(H) 1, Heptad 2 and their Interspace(IS) are required for oligomerization. The expression vector backbone is pVR1012x/s (VRC2000).

VRC 5360 pVRC1012(x/s)-gp140(dCFI)(Brazil C)/dV234

The protein sequence of the envelope polyprotein (gp160) from 92BR025 (R5-tropic, GenBank accession number U52953) was used to create a synthetic version of the gene (Brazil-C gp140delCFI) using codons optimized for expression in human cells. The nucleotide sequence of Brazil-C gp140(delCFI) shows little homology to the gene 92BR025, but the protein encoded is the same. The XbaI (18 nt upstream from ATG) to BamHI (1910 nt down-stream from ATG) fragment which contains polylinker at the 5' end, Kozak sequence and ATG was cloned into the XbaI to BamHI sites of pVR1012x/s backbone. The truncated envelope polyprotein contains deletion in the V2, V3, V4 loops (a.a.154-191, 330-358, 384-408) of the SU protein. It also lacks the Fusion and Cleavage (F/CL) domains(a.a. 496-529), the Interspace (IS) between Heptad (H) 1 and 2(a.a.586-612), transmembrane domain, and cytoplasmic domain in the TM protein. Regions important for oligomer formation may be partially functional. Heptad(H) 1, Heptad 2 and their Interspace(IS) are required for oligomerization. The expression vector backbone is pVR1012x/s (VRC2000).

VRC 5361 pVRC1012(x/s)-gp140(dCFI)(Brazil C)/dV24

The protein sequence of the envelope polyprotein (gp160) from 92BR025 (R5-tropic, GenBank accession number U52953) was used to create a synthetic version of the gene (Brazil-C gp140delCFI) using codons optimized for expression in human cells. The nucleotide sequence of Brazil-C gp140(delCFI) shows little homology to the gene 92BR025, but the protein encoded is the same. The XbaI (18 nt upstream from ATG) to BamHI (1910 nt down-stream from ATG) fragment which contains polylinker at the 5' end, Kozak sequence and ATG was cloned into the XbaI to BamHI sites of pVR1012x/s backbone. The truncated envelope polyprotein contains deletion in the V2, V4 loops (a.a.154-

191, 384-408) of the SU protein. It also lacks the Fusion and Cleavage (F/CL) domains(a.a.496-529), the Interspace (IS) between Heptad (H) 1 and 2(a.a.586-612), transmembrane domain, and cytoplasmic domain in the TM protein. Regions important for oligomer formation may be partially functional. Heptad(H) 1, Heptad 2 and their Interspace(IS) are required for oligomerization. The expression vector backbone is pVR1012x/s (VRC2000).

VRC 5362 pVRC1012(x/s)-gp140(dCFI)(Brazil C)/dV3

The protein sequence of the envelope polyprotein (gp160) from 92BR025 (R5-tropic, GenBank accession number U52953) was used to create a synthetic version of the gene (Brazil-C gp140delCFI) using codons optimized for expression in human cells. The nucleotide sequence of Brazil-C gp140(delCFI) shows little homology to the gene 92BR025, but the protein encoded is the same. The XbaI (18 nt upstream from ATG) to BamHI (1910 nt down-stream from ATG) fragment which contains polylinker at the 5' end, Kozak sequence and ATG was cloned into the XbaI to BamHI sites of pVR1012x/s backbone. The truncated envelope polyprotein contains deletion in the V3 loop(a.a.330-358) of the SU protein. It also lacks the Fusion and Cleavage (F/CL) domains(a.a.496-529), the Interspace (IS) between Heptad (H) 1 and 2(a.a.586-612), transmembrane domain, and cytoplasmic domain in the TM protein. Regions important for oligomer formation may be partially functional. Heptad(H) 1, Heptad 2 and their Interspace(IS) are required for oligomerization. The expression vector backbone is pVR1012x/s (VRC2000).

VRC 5363 pVRC1012(x/s)-gp140(dCFI)(Brazil C)/dV34

The protein sequence of the envelope polyprotein (gp160) from 92BR025 (R5-tropic, GenBank accession number U52953) was used to create a synthetic version of the gene (Brazil-C gp140delCFI) using codons optimized for expression in human cells. The nucleotide sequence of Brazil-C gp140(delCFI) shows little homology to the gene 92BR025, but the protein encoded is the same. The XbaI (18 nt upstream from ATG) to BamHI (1910 nt down-stream from ATG) fragment which contains polylinker at the 5' end, Kozak sequence and ATG was cloned into the XbaI to BamHI sites of pVR1012x/s backbone. The truncated envelope polyprotein contains deletion in the V3, V4 loops (a.a.330-358, 384-408) of the SU protein. It also lacks the Fusion and Cleavage (F/CL) domains(a.a.496-529), the Interspace (IS) between Heptad (H) 1 and 2(a.a.586-612), transmembrane domain, and cytoplasmic domain in the TM protein. Regions important for oligomer formation may be partially functional. Heptad(H) 1, Heptad 2 and their Interspace(IS) are required for oligomerization. The expression vector backbone is pVR1012x/s (VRC2000).

VRC 5364 pVRC1012(x/s)-gp140(dCFI)(Brazil C)/dV4

The protein sequence of the envelope polyprotein (gp160) from 92BR025 (R5-tropic, GenBank accession number U52953) was used to create a synthetic version of the gene (Brazil-C gp140delCFI) using codons optimized for expression in human cells. The nucleotide sequence of Brazil-C gp140(delCFI) shows little homology to the gene 92BR025, but the protein encoded is the same. The XbaI (18 nt upstream from ATG) to BamHI (1910 nt down-stream from ATG) fragment which contains polylinker at the 5' end, Kozak sequence and ATG was cloned into the XbaI to BamHI sites of pVR1012x/s backbone. The truncated envelope polyprotein contains deletion in the V4 loop(a.a.384-408) of the SU protein. It also lacks the Fusion and Cleavage (F/CL) domains(a.a.496-529), the Interspace (IS) between Heptad (H) 1 and 2(a.a.586-612), transmembrane domain, and cytoplasmic domain in the TM protein. Regions important for oligomer formation may be partially functional. Heptad(H) 1, Heptad 2 and their Interspace(IS) are required for oligomerization. The expression vector backbone is pVR1012x/s (VRC2000).

VRC 5365

PVRC1012(x/s)-gp145(dCFI)(Brazil C)/dV1

The protein sequence of the envelope polyprotein (gp160) from 92BR025 (R5-tropic, GenBank accession number U52953) was used to create a synthetic version of the gene (Brazil-C gp145delCFI) using codons optimized for expression in human cells. The nucleotide sequence of Brazil-C gp145(delCFI) shows little homology to the gene 92BR025, but the protein encoded is the same. The XbaI (18 nt upstream from ATG) to BamHI (1910 nt down-stream from ATG) fragment which contains polylinker at the 5' end, Kozak sequence and ATG was cloned into the XbaI to BamHI sites of pVR1012x/s backbone. The truncated envelope polyprotein contains deletion in the V1 loop(a.a.133-148) of the SU protein. It also lacks the Fusion and Cleavage (F/CL) domains(a.a.496-529), the Interspace (IS) between Heptad (H) 1 and 2(a.a.586-612), and Cytoplasmic domain in the TM protein. Regions important for oligomer formation may be partially functional. Heptad(H) 1, Heptad 2 and their Interspace(IS) are required for oligomerization. The expression vector backbone is pVR1012x/s (VRC2000).

VRC 5366

PVRC1012(x/s)-gp145(dCFI)(Brazil C)/dV12

The protein sequence of the envelope polyprotein (gp160) from 92BR025 (R5-tropic, GenBank accession number U52953) was used to create a synthetic version of the gene (Brazil-C gp145delCFI) using codons optimized for expression in human cells. The nucleotide sequence of Brazil-C gp145(delCFI) shows little homology to the gene 92BR025, but the protein encoded is the same. The XbaI (18 nt upstream from ATG) to BamHI (1910 nt down-stream from ATG) fragment which contains polylinker at the 5' end, Kozak sequence and ATG was cloned into the XbaI to BamHI sites of pVR1012x/s backbone. The truncated envelope polyprotein contains deletion in the V1, V2 loops (a.a.133-191) of the SU protein. It also lacks the Fusion and Cleavage (F/CL) domains(a.a.496-529), the Interspace (IS) between Heptad (H) 1 and 2(a.a.586-612), and Cytoplasmic domain in the TM protein. Regions important for oligomer formation may be partially functional. Heptad(H) 1, Heptad 2 and their Interspace(IS) are required for oligomerization. The expression vector backbone is pVR1012x/s (VRC2000).

VRC 5367

PVRC1012(x/s)-gp145(dCFI)(Brazil C)/dV123

The protein sequence of the envelope polyprotein (gp160) from 92BR025 (R5-tropic, GenBank accession number U52953) was used to create a synthetic version of the gene (Brazil-C gp145delCFI) using codons optimized for expression in human cells. The nucleotide sequence of Brazil-C gp145(delCFI) shows little homology to the gene 92BR025, but the protein encoded is the same. The XbaI (18 nt upstream from ATG) to BamHI (1910 nt down-stream from ATG) fragment which contains polylinker at the 5' end, Kozak sequence and ATG was cloned into the XbaI to BamHI sites of pVR1012x/s backbone. The truncated envelope polyprotein contains deletion in the V1, V2, V3 loops (a.a.133-191, 330-358) of the SU protein. It also lacks the Fusion and Cleavage (F/CL) domains(a.a.496-529), the Interspace (IS) between Heptad (H) 1 and 2(a.a.586-612), and Cytoplasmic domain in the TM protein. Regions important for oligomer formation may be partially functional. Heptad (H) 1, Heptad 2 and their Interspace(IS) are required for oligomerization. The expression vector backbone is pVR1012x/s (VRC2000).

VRC 5368

PVRC1012(x/s)-gp145(dCFI)(Brazil C)/dV1234

The protein sequence of the envelope polyprotein (gp160) from 92BR025 (R5-tropic, GenBank accession number U52953) was used to create a synthetic version of the gene (Brazil-C gp145delCFI) using codons optimized for expression in human cells. The nucleotide sequence of Brazil-C gp145(delCFI) shows little homology to the gene 92BR025, but the protein encoded is the same. The XbaI (18 nt upstream from ATG) to BamHI (1910 nt down-stream from ATG) fragment which contains polylinker at the 5' end, Kozak sequence and ATG was cloned into the XbaI to BamHI sites of pVR1012x/s backbone. The truncated envelope polyprotein contains deletion in the V1, V2, V3, V4 loops (a.a.133-191, 330-358, 384-408) of the SU protein. It also lacks the Fusion and Cleavage (F/CL) domains(a.a.496-529), the Interspace (IS) between Heptad (H) 1 and 2(a.a.586-612), and Cytoplasmic domain in the TM protein. Regions important for oligomer formation may be partially functional. Heptad(H) 1, Heptad 2 and their Interspace(IS) are required for oligomerization. The expression vector backbone is pVR1012x/s (VRC2000).

VRC 5369

PVRC1012(x/s)-gp145(dCFI)(Brazil C)/dV124

The protein sequence of the envelope polyprotein (gp160) from 92BR025 (R5-tropic, GenBank accession number U52953) was used to create a synthetic version of the gene (Brazil-C gp145delCFI) using codons optimized for expression in human cells. The nucleotide sequence of Brazil-C gp145(delCFI) shows little homology to the gene 92BR025, but the protein encoded is the same. The XbaI (18 nt upstream from ATG) to BamHI (1910 nt down-stream from ATG) fragment which contains polylinker at the 5' end, Kozak sequence and ATG was cloned into the XbaI to BamHI sites of pVR1012x/s backbone. The truncated envelope polyprotein contains deletion in the V1, V2, V4 loops (a.a.133-148, 154-191, 384-408) of the SU protein. It also lacks the Fusion and Cleavage (F/CL) domains(a.a. 496-529), the Interspace (IS) between Heptad (H) 1 and 2(a.a.586-612), and Cytoplasmic domain in the TM protein. Regions important for oligomer formation may be partially functional. Heptad(H) 1, Heptad 2 and their Interspace(IS) are required for oligomerization. The expression vector backbone is pVR1012x/s (VRC2000).

VRC 5370

PVRC1012(x/s)-gp145(dCFI)(Brazil C)/dV13

The protein sequence of the envelope polyprotein (gp160) from 92BR025 (R5-tropic, GenBank accession number U52953) was used to create a synthetic version of the gene (Brazil-C gp145delCFI) using codons optimized for expression in human cells. The nucleotide sequence of Brazil-C gp145(delCFI) shows little homology to the gene 92BR025, but the protein encoded is the same. The XbaI (18 nt upstream from ATG) to BamHI (1910 nt down-stream from ATG) fragment which contains polylinker at the 5' end, Kozak sequence and ATG was cloned into the XbaI to BamHI sites of pVR1012x/s backbone. The truncated envelope polyprotein contains deletion in the V1, V3 loops (a.a.133-148, 330-358) of the SU protein. It also lacks the Fusion and Cleavage (F/CL) domains(a.a.496-529), the Interspace (IS) between Heptad (H) 1 and 2(a.a.586-612), and Cytoplasmic domain in the TM protein. Regions important for oligomer formation may be partially functional. Heptad(H) 1, Heptad 2 and their Interspace(IS) are required for oligomerization. The expression vector backbone is pVR1012x/s (VRC2000).

VRC 5371

PVRC1012(x/s)-gp145(dCFI)(Brazil C)/dV134

The protein sequence of the envelope polyprotein (gp160) from 92BR025 (R5-tropic, GenBank accession number U52953) was used to create a synthetic version of the gene (Brazil-C gp145delCFI) using codons optimized for expression in human cells. The nucleotide sequence of Brazil-C gp145(delCFI) shows little homology to the gene 92BR025, but the protein encoded is the same. The XbaI (18 nt upstream from ATG) to BamHI (1910 nt down-stream from ATG) fragment which contains polylinker at the 5' end, Kozak sequence and ATG was cloned into the XbaI to BamHI sites of pVR1012x/s backbone. The truncated envelope polyprotein contains deletion in the V1, V3, V4 loops (a.a.133-148, 330-358, 384-408) of the SU protein. It also lacks the Fusion and Cleavage (F/CL) domains(a.a. 496-529), the Interspace (IS) between Heptad (H) 1 and 2(a.a.586-612), and Cytoplasmic domain in the TM protein. Regions important for oligomer formation may be partially functional. Heptad(H) 1, Heptad 2 and their Interspace(IS) are required for oligomerization. The expression vector backbone is pVR1012x/s (VRC2000).

VRC 5372

PVRC1012(x/s)-gp145(dCFI)(Brazil C)/dV14

The protein sequence of the envelope polyprotein (gp160) from 92BR025 (R5-tropic, GenBank accession number U52953) was used to create a synthetic version of the gene (Brazil-C gp145delCFI) using codons optimized for expression in human cells. The nucleotide sequence of Brazil-C gp145(delCFI) shows little homology to the gene 92BR025, but the protein encoded is the same. The XbaI (18 nt upstream from ATG) to BamHI (1910 nt down-stream from ATG) fragment which contains polylinker at the 5' end, Kozak sequence and ATG was cloned into the XbaI to BamHI sites of pVR1012x/s backbone. The truncated envelope polyprotein contains deletion in the V1, V4 loops (a.a.133-148, 384-408) of the SU protein. It also lacks the Fusion and Cleavage (F/CL) domains(a.a.496-529), the Interspace (IS) between Heptad (H) 1 and 2(a.a.586-612), and Cytoplasmic domain in the TM protein. Regions important for oligomer formation may be partially functional. Heptad(H) 1, Heptad 2 and their Interspace(IS) are required for oligomerization. The expression vector backbone is pVR1012x/s (VRC2000).

VRC 5373

PVRC1012(x/s)-gp 145(dCFI)(Brazil C)/dV2

The protein sequence of the envelope polyprotein (gp160) from 92BR025 (R5-tropic, GenBank accession number U52953) was used to create a synthetic version of the gene (Brazil-C gp145delCFI) using codons optimized for expression in human cells. The nucleotide sequence of Brazil-C gp145(delCFI) shows little homology to the gene 92BR025, but the protein encoded is the same. The XbaI (18 nt upstream from ATG) to BamHI (1910 nt down-stream from ATG) fragment which contains polylinker at the 5' end, Kozak sequence and ATG was cloned into the XbaI to BamHI sites of pVR1012x/s backbone. The truncated envelope polyprotein contains deletion in the V2 loop (a.a.154-191) of the SU protein. It also lacks the Fusion and Cleavage (F/CL) domains(a.a.496-529), the Interspace (IS) between Heptad (H) 1 and 2(a.a.586-612), and Cytoplasmic domain in the TM protein. Regions important for oligomer formation may be partially functional. Heptad(H) 1, Heptad 2 and their Interspace(IS) are required for oligomerization. The expression vector backbone is pVR1012x/s (VRC2000).

VRC 5374

PVRC1012(x/s)-gp145(dCFI)(Brazil C)/dV23

The protein sequence of the envelope polyprotein (gp160) from 92BR025 (R5-tropic, GenBank accession number U52953) was used to create a synthetic version of the gene (Brazil-C gp145delCFI) using codons optimized for expression in human cells. The nucleotide sequence of Brazil-C gp145(delCFI) shows little homology to the gene 92BR025, but the protein encoded is the same. The XbaI (18 nt upstream from ATG) to BamHI (1910 nt down-stream from ATG) fragment which contains polylinker at the 5' end, Kozak sequence and ATG was cloned into the XbaI to BamHI sites of pVR1012x/s backbone. The truncated envelope polyprotein contains deletion in the V2, V3 loops (a.a.154-191, 330-358) of the SU protein. It also lacks the Fusion and Cleavage (F/CL) domains(a.a.496-529), the Interspace (IS) between Heptad (H) 1 and 2(a.a.586-612), and Cytoplasmic domain in the TM protein. Regions important for oligomer formation may be partially functional. Heptad(H) 1, Heptad 2 and their Interspace(IS) are required for oligomerization. The expression vector backbone is pVR1012x/s (VRC2000).

VRC 5375

PVRC1012(x/s)-gp145(dCFI)(Brazil C)/dV234

The protein sequence of the envelope polyprotein (gp160) from 92BR025 (R5-tropic, GenBank accession number U52953) was used to create a synthetic version of the gene (Brazil-C gp145delCFI) using codons optimized for expression in human cells. The nucleotide sequence of Brazil-C gp145(delCFI) shows little homology to the gene 92BR025, but the protein encoded is the same. The XbaI (18 nt upstream from ATG) to BamHI (1910 nt down-stream from ATG) fragment which contains polylinker at the 5' end, Kozak sequence and ATG was cloned into the XbaI to BamHI sites of pVR1012x/s backbone. The truncated envelope polyprotein contains deletion in the V2, V3, V4 loops (a.a.154-191, 330-358, 384-408) of the SU protein. It also lacks the Fusion and Cleavage (F/CL) domains(a.a. 496-529), the Interspace (IS) between Heptad (H) 1 and 2(a.a.586-612), and Cytoplasmic domain in the TM protein. Regions important for oligomer formation may be partially functional. Heptad(H) 1, Heptad 2 and their Interspace(IS) are required for oligomerization. The expression vector backbone is pVR1012x/s (VRC2000).

VRC 5376

PVRC1012(x/s)-gp145(dCFI)(Brazil C)/dV24

The protein sequence of the envelope polyprotein (gp160) from 92BR025 (R5-tropic, GenBank accession number U52953) was used to create a synthetic version of the gene (Brazil-C gp145delCFI) using codons optimized for expression in human cells. The nucleotide sequence of Brazil-C gp145(delCFI) shows little homology to the gene 92BR025, but the protein encoded is the same. The XbaI (18 nt upstream from ATG) to BamHI (1910 nt down-stream from ATG) fragment which contains polylinker at the 5' end, Kozak sequence and ATG was cloned into the XbaI to BamHI sites of pVR1012x/s backbone. The truncated envelope polyprotein contains deletion in the V2, V4 loops (a.a.154-191, 384-408) of the SU protein. It also lacks the Fusion and Cleavage (F/CL) domains(a.a.496-529), the Interspace (IS) between Heptad (H) 1 and 2(a.a.586-612), and Cytoplasmic domain in the TM protein. Regions important for oligomer formation may be partially functional. Heptad(H) 1, Heptad 2 and their Interspace(IS) are required for oligomerization. The expression vector backbone is pVR1012x/s (VRC2000).

VRC 5377

PVRC1012(x/s)-gp145(dCFI)(Brazil C)/dV3

The protein sequence of the envelope polyprotein (gp160) from 92BR025 (R5-tropic, GenBank accession number U52953) was used to create a synthetic version of the gene (Brazil-C gp145delCFI) using codons optimized for expression in human cells. The nucleotide sequence of Brazil-C gp145(delCFI) shows little homology to the gene 92BR025, but the protein encoded is the same. The XbaI (18 nt upstream from ATG) to BamHI (1910 nt down-stream from ATG) fragment which contains polylinker at the 5' end, Kozak sequence and ATG was cloned into the XbaI to BamHI sites of pVR1012x/s backbone. The truncated envelope polyprotein contains deletion in the V3 loop (a.a.330-358) of the SU protein. It also lacks the Fusion and Cleavage (F/CL) domains(a.a.496-529), the Interspace (IS) between Heptad (H) 1 and 2(a.a.586-612), and Cytoplasmic domain in the TM protein. Regions important for oligomer formation may be partially functional. Heptad(H) 1, Heptad 2 and their Interspace(IS) are required for oligomerization. The expression vector backbone is pVR1012x/s (VRC2000).

VRC 5378

PVRC1012(x/s)-gp145(dCFI)(Brazil C)/dV34

The protein sequence of the envelope polyprotein (gp160) from 92BR025 (R5-tropic, GenBank accession number U52953) was used to create a synthetic version of the gene (Brazil-C gp145delCFI) using codons optimized for expression in human cells. The nucleotide sequence of Brazil-C gp145(delCFI) shows little homology to the gene 92BR025, but the protein encoded is the same. The XbaI (18 nt upstream from ATG) to BamHI (1910 nt down-stream from ATG) fragment which contains polylinker at the 5' end, Kozak sequence and ATG was cloned into the XbaI to BamHI sites of pVR1012x/s backbone. The truncated envelope polyprotein contains deletion in the V3, V4 loops (a.a.330-358, 384-408) of the SU protein. It also lacks the Fusion and Cleavage (F/CL) domains(a.a.496-529), the Interspace (IS) between Heptad (H) 1 and 2(a.a.586-612), and Cytoplasmic domain in the TM protein. Regions important for oligomer formation may be partially functional. Heptad(H) 1, Heptad 2 and their Interspace(IS) are required for oligomerization. The expression vector backbone is pVR1012x/s (VRC2000).

VRC 5379

PVRC1012(x/s)-gp145(dCFI)(Brazil C)/dV4

The protein sequence of the envelope polyprotein (gp160) from 92BR025 (R5-tropic, GenBank accession number U52953) was used to create a synthetic version of the gene (Brazil-C gp145delCFI) using codons optimized for expression in human cells. The nucleotide sequence of Brazil-C gp145(delCFI) shows little homology to the gene 92BR025, but the protein encoded is the same. The XbaI (18 nt upstream from ATG) to BamHI (1910 nt down-stream from ATG) fragment which contains polylinker at the 5' end, Kozak sequence and ATG was cloned into the XbaI to BamHI sites of pVR1012x/s backbone. The truncated envelope polyprotein contains deletion in the V4 loop (a.a.384-408) of the SU protein. It also lacks the Fusion and Cleavage (F/CL) domains(a.a.496-529), the Interspace (IS) between Heptad (H) 1 and 2(a.a.586-612), and Cytoplasmic domain in the TM protein. Regions important for oligomer formation may be partially functional. Heptad(H) 1, Heptad 2 and their Interspace(IS) are required for oligomerization. The expression vector backbone is pVR1012x/s (VRC2000).

VRC5500 pVR1012x/s R5(SA-C)gp140(dCFI) dV1/h

The protein sequence of the envelope polyprotein (gp140delCFI) from 97ZA012 (R5-tropic, GenBank accession number AF286227) was used to create a synthetic version of the gene (Clade-C gp140delCFI) using codons optimized for expression in human cells. The nucleotide sequence R5gp140delCFI shows little homology to the gene 97ZA012, but the protein encoded is the same. The XbaI (18 nt up-stream from ATG) to BamHI (1914 nt down-stream from ATG) fragment which contains polylinker at the 5' end, Kozak sequence and ATG was cloned into the XbaI to BamHI sites of pVR1012x/s backbone. The truncated envelope polyprotein lacks the V1 loop (a.a.136-150), the Fusion and Cleavage (F/CL) domains (a.a.487-520), the Interspace (IS) between Heptad (H) 1 and 2 (a.a.577-605), the transmembrane domain and the intracellular region. Regions important for oligomer formation may be partially functional. Heptad (H) 1, Heptad 2 and their Interspace(IS) are required for oligomerization. The expression vector backbone is pVR1012x/s (VRC2000).

VRC5501 pVR1012x/s R5(SA-C)gp140(dCFI) dV12/h

The protein sequence of the envelope polyprotein (gp140delCFI) from 97ZA012 (R5-tropic, GenBank accession number AF286227) was used to create a synthetic version of the gene (Clade-C gp140delCFI) using codons optimized for expression in human cells. The nucleotide sequence R5gp140delCFI shows little homology to the gene 97ZA012, but the protein encoded is the same. The XbaI (18 nt up-stream from ATG) to BamHI (1914 nt down-stream from ATG) fragment which contains polylinker at the 5' end, Kozak sequence and ATG was cloned into the XbaI to BamHI sites of pVR1012x/s backbone. The truncated envelope polyprotein lacks the V1, V2 loops (a.a.136-194), the Fusion and Cleavage (F/CL) domains (a.a.487-520), the Interspace (IS) between Heptad (H) 1 and 2 (a.a.577-605), the transmembrane domain and the intracellular region. Regions important for oligomer formation may be partially functional. Heptad(H) 1, Heptad 2 and their Interspace(IS) are required for oligomerization. The expression vector backbone is pVR1012x/s (VRC2000).

VRC 5502 pVR1012x/s R5(SA-C)gp140(dCFI) dV123/h

The protein sequence of the envelope polyprotein (gp140delCFI) from 97ZA012 (R5-tropic, GenBank accession number AF286227) was used to create a synthetic version of the gene (Clade-C gp140delCFI) using codons optimized for expression in human cells. The nucleotide sequence R5gp140delCFI shows little homology to the gene 97ZA012, but the protein encoded is the same. The XbaI (18 nt up-stream from ATG) to BamHI (1914 nt down-stream from ATG) fragment which contains polylinker at the 5' end, Kozak sequence and ATG was cloned into the XbaI to BamHI sites of pVR1012x/s backbone. The truncated envelope polyprotein lacks the V1, V2, V3 loops (a.a.136-194, 297-325), the Fusion and Cleavage (F/CL) domains (a.a.487-520), the Interspace (IS) between Heptad (H) 1 and 2 (a.a.577-605), the transmembrane domain and the intracellular region. Regions important for oligomer formation may be partially functional. Heptad(H) 1, Heptad 2 and their Interspace(IS) are required for oligomerization. The expression vector backbone is pVR1012x/s (VRC2000).

VRC5503 pVR1012x/s R5(SA-C)gp140(dCFI)dV1234/h

The protein sequence of the envelope polyprotein (gp140delCFI) from 97ZA012 (R5-tropic, GenBank accession number AF286227) was used to create a synthetic version of the gene (Clade-C gp140delCFI) using codons optimized for expression in human cells. The nucleotide sequence R5gp140delCFI shows little homology to the gene 97ZA012, but the protein encoded is the same. The XbaI (18 nt up-stream from ATG) to BamHI (1914 nt down-stream from ATG) fragment which contains polylinker at the 5' end, Kozak sequence and ATG was cloned into the XbaI to BamHI sites of pVR1012x/s backbone. The truncated envelope polyprotein lacks the V1, V2, V3, V4 loops (a.a.136-194, 297-325, 385-399), the Fusion and Cleavage (F/CL) domains (a.a.487-520), the Interspace (IS) between Heptad (H) 1 and 2 (a.a.577-605), the transmembrane domain and the intracellular region. Regions important for oligomer formation may be partially functional. Heptad(H) 1, Heptad 2 and their Interspace(IS) are required for oligomerization. The expression vector backbone is pVR1012x/s (VRC2000).

VRC5504 pVR1012x/s R5(SA-C)gp140(dCFI)dV124/h

The protein sequence of the envelope polyprotein (gp140delCFI) from 97ZA012 (R5-tropic, GenBank accession number AF286227) was used to create a synthetic version of the gene (Clade-C gp140delCFI) using codons optimized for expression in human cells. The nucleotide sequence R5gp140delCFI shows little homology to the gene 97ZA012, but the protein encoded is the same. The XbaI (18 nt up-stream from ATG) to BamHI (1914 nt down-stream from ATG) fragment which contains polylinker at the 5' end, Kozak sequence and ATG was cloned into the XbaI to BamHI sites of pVR1012x/s backbone. The truncated envelope polyprotein lacks the V1, V2, V4 loops (a.a.136-194, 385-399), the Fusion and Cleavage (F/CL) domains (a.a.487-520), the Interspace (IS) between Heptad (H) 1 and 2 (a.a.577-605), the transmembrane domain and the intracellular region. Regions important for oligomer formation may be partially functional. Heptad(H) 1, Heptad 2 and their Interspace(IS) are required for oligomerization. The expression vector backbone is pVR1012x/s (VRC2000).

VRC5505 pVR1012x/s R5(SA-C)gp140(dCFI)dV13/h

The protein sequence of the envelope polyprotein (gp140delCFI) from 97ZA012 (R5-tropic, GenBank accession number AF286227) was used to create a synthetic version of the gene (Clade-C gp140delCFI) using codons optimized for expression in human cells. The nucleotide sequence R5gp140delCFI shows little homology to the gene 97ZA012, but the protein encoded is the same. The XbaI (18 nt up-stream from ATG) to BamHI (1914 nt down-stream from ATG) fragment which contains polylinker at the 5' end, Kozak sequence and ATG was cloned into the XbaI to BamHI sites of pVR1012x/s backbone. The truncated envelope polyprotein lacks the V1, V3 loops (a.a.136-150, 297-325), the Fusion and Cleavage (F/CL) domains (a.a.487-520), the Interspace (IS) between Heptad (H) 1 and 2 (a.a.577-605), the transmembrane domain and the intracellular region. Regions important for oligomer formation may be partially functional. Heptad(H) 1, Heptad 2 and their Interspace(IS) are required for oligomerization. The expression vector backbone is pVR1012x/s (VRC2000).

VRC5506 pVR1012x/s R5(SA-C)gp140(dCFI)dV134/h

The protein sequence of the envelope polyprotein (gp140delCFI) from 97ZA012 (R5-tropic, GenBank accession number AF286227) was used to create a synthetic version of the gene (Clade-C gp140delCFI) using codons optimized for expression in human cells. The nucleotide sequence R5gp140delCFI shows little homology to the gene 97ZA012, but the protein encoded is the same. The XbaI (18 nt up-stream from ATG) to BamHI (1914 nt down-stream from ATG) fragment which contains polylinker at the 5' end, Kozak sequence and ATG was cloned into the XbaI to BamHI sites of pVR1012x/s backbone. The truncated envelope polyprotein lacks the V1, V3, V4 loops (a.a.136-150, 297-325, 385-399), the Fusion and Cleavage (F/CL) domains (a.a.487-520), the Interspace (IS) between Heptad (H) 1 and 2 (a.a.577-605), the transmembrane domain and the intracellular region. Regions important for oligomer formation may be partially functional. Heptad(H) 1, Heptad 2 and their Interspace(IS) are required for oligomerization. The expression vector backbone is pVR1012x/s (VRC2000).

VRC5507 pVR1012x/s R5(SA-C)gp140(dCFI)dV14/h

The protein sequence of the envelope polyprotein (gp140delCFI) from 97ZA012 (R5-tropic, GenBank accession number AF286227) was used to create a synthetic version of the gene (Clade-C gp140delCFI) using codons optimized for expression in human cells. The nucleotide sequence R5gp140delCFI shows little homology to the gene 97ZA012, but the protein encoded is the same. The XbaI (18 nt up-stream from ATG) to BamHI (1914 nt down-stream from ATG) fragment which contains polylinker at the 5' end, Kozak sequence and ATG was cloned into the XbaI to BamHI sites of pVR1012x/s backbone. The truncated envelope polyprotein lacks the V1, V4 loops (a.a.136-150, 385-399), the Fusion and Cleavage (F/CL) domains (a.a.487-520), the Interspace (IS) between Heptad (H) 1 and 2 (a.a.577-605), the transmembrane domain and the intracellular region. Regions important for oligomer formation may be partially functional. Heptad(H) 1, Heptad 2 and their Interspace(IS) are required for oligomerization. The expression vector backbone is pVR1012x/s (VRC2000).

VRC5508 pVR1012x/s R5(SA-C)gp140(dCFI)dV2/h

The protein sequence of the envelope polyprotein (gp140delCFI) from 97ZA012 (R5-tropic, GenBank accession number AF286227) was used to create a synthetic version of the gene (Clade-C gp140delCFI) using codons optimized for expression in human cells. The nucleotide sequence R5gp140delCFI shows little homology to the gene 97ZA012, but the protein encoded is the same. The XbaI (18 nt up-stream from ATG) to BamHI (1914 nt down-stream from ATG) fragment which contains polylinker at the 5' end, Kozak sequence and ATG was cloned into the XbaI to BamHI sites of pVR1012x/s backbone. The truncated envelope polyprotein lacks the V2 loop (a.a.156-194), the Fusion and Cleavage (F/CL) domains (a.a.487-520), the Interspace (IS) between Heptad (H) 1 and 2 (a.a.577-605), the transmembrane domain and the intracellular region. Regions important for oligomer formation may be partially functional. Heptad (H) 1, Heptad 2 and their Interspace(IS) are required for oligomerization. The expression vector backbone is pVR1012x/s (VRC2000).

VRC5509 pVR1012x/s R5(SA-C)gp140(dCFI)dV23/h

The protein sequence of the envelope polyprotein (gp140delCFI) from 97ZA012 (R5-tropic, GenBank accession number AF286227) was used to create a synthetic version of the gene (Clade-C gp140delCFI) using codons optimized for expression in human cells. The nucleotide sequence R5gp140delCFI shows little homology to the gene 97ZA012, but the protein encoded is the same. The XbaI (18 nt up-stream from ATG) to BamHI (1914 nt down-stream from ATG) fragment which contains polylinker at the 5' end, Kozak sequence and ATG was cloned into the XbaI to BamHI sites of pVR1012x/s backbone. The truncated envelope polyprotein lacks the V2, V3 loops (a.a.156-194, 297-325), the Fusion and Cleavage (F/CL) domains (a.a.487-520), the Interspace (IS) between Heptad (H) 1 and 2 (a.a.577-605), the transmembrane domain and the intracellular region. Regions important for oligomer formation may be partially functional. Heptad(H) 1, Heptad 2 and their Interspace(IS) are required for oligomerization. The expression vector backbone is pVR1012x/s (VRC2000).

VRC5510 pVR1012x/s R5(SA-C)gp140(dCFI)dV234/h

The protein sequence of the envelope polyprotein (gp140delCFI) from 97ZA012 (R5-tropic, GenBank accession number AF286227) was used to create a synthetic version of the gene (Clade-C gp140delCFI) using codons optimized for expression in human cells. The nucleotide sequence R5gp140delCFI shows little homology to the gene 97ZA012, but the protein encoded is the same. The XbaI (18 nt up-stream from ATG) to BamHI (1914 nt down-stream from ATG) fragment which contains polylinker at the 5' end, Kozak sequence and ATG was cloned into the XbaI to BamHI sites of pVR1012x/s backbone. The truncated envelope polyprotein lacks the V2, V3, V4 loops (a.a.156-194, 297-325, 385-399), the Fusion and Cleavage (F/CL) domains (a.a.487-520), the Interspace (IS) between Heptad (H) 1 and 2 (a.a.577-605), the transmembrane domain and the intracellular region. Regions important for oligomer formation may be partially functional. Heptad(H) 1, Heptad 2 and their Interspace(IS) are required for oligomerization. The expression vector backbone is pVR1012x/s (VRC2000).

VRC5511 pVR1012x/s R5(SA-C)gp140(dCFI)dV24/h

The protein sequence of the envelope polyprotein (gp140delCFI) from 97ZA012 (R5-tropic, GenBank accession number AF286227) was used to create a synthetic version of the gene (Clade-C gp140delCFI) using codons optimized for expression in human cells. The nucleotide sequence R5gp140delCFI shows little homology to the gene 97ZA012, but the protein encoded is the same. The XbaI (18 nt up-stream from ATG) to BamHI (1914 nt down-stream from ATG) fragment which contains polylinker at the 5' end, Kozak sequence and ATG was cloned into the XbaI to BamHI sites of pVR1012x/s backbone. The truncated envelope polyprotein lacks the V2, V4 loops (a.a.156-194, 385-399), the Fusion and Cleavage (F/CL) domains (a.a.487-520), the Interspace (IS) between Heptad (H) 1 and 2 (a.a.577-605), the transmembrane domain and the intracellular region. Regions important for oligomer formation may be partially functional. Heptad(H) 1, Heptad 2 and their Interspace(IS) are required for oligomerization. The expression vector backbone is pVR1012x/s (VRC2000).

VRC5512 pVR1012x/s R5(SA-C)gp140(dCFI)dV3/h

The protein sequence of the envelope polyprotein (gp140delCFI) from 97ZA012 (R5-tropic, GenBank accession number AF286227) was used to create a synthetic version of the gene (Clade-C gp140delCFI) using codons optimized for expression in human cells. The nucleotide sequence R5gp140delCFI shows little homology to the gene 97ZA012, but the protein encoded is the same. The XbaI (18 nt up-stream from ATG) to BamHI (1914 nt down-stream from ATG) fragment which contains polylinker at the 5' end, Kozak sequence and ATG was cloned into the XbaI to BamHI sites of pVR1012x/s backbone. The truncated envelope polyprotein lacks the V3 loop (a.a.297-325), the Fusion and Cleavage (F/CL) domains (a.a.487-520), the Interspace (IS) between Heptad (H) 1 and 2 (a.a.577-605), the transmembrane domain and the intracellular region. Regions important for oligomer formation may be partially functional. Heptad (H) 1, Heptad 2 and their Interspace(IS) are required for oligomerization. The expression vector backbone is pVR1012x/s (VRC2000).

VRC5513 pVR1012x/s R5(SA-C)gp140(dCFI)dV34/h

The protein sequence of the envelope polyprotein (gp140delCFI) from 97ZA012 (R5-tropic, GenBank accession number AF286227) was used to create a synthetic version of the gene (Clade-C gp140delCFI) using codons optimized for expression in human cells. The nucleotide sequence R5gp140delCFI shows little homology to the gene 97ZA012, but the protein encoded is the same. The XbaI (18 nt up-stream from ATG) to BamHI (1914 nt down-stream from ATG) fragment which contains polylinker at the 5' end, Kozak sequence and ATG was cloned into the XbaI to BamHI sites of pVR1012x/s backbone. The truncated envelope polyprotein lacks the V3, V4 loops (a.a.297-325, 385-399), the Fusion and Cleavage (F/CL) domains (a.a.487-520), the Interspace (IS) between Heptad (H) 1 and 2 (a.a.577-605), the transmembrane domain and the intracellular region. Regions important for oligomer formation may be partially functional. Heptad(H) 1, Heptad 2 and their Interspace(IS) are required for oligomerization. The expression vector backbone is pVR1012x/s (VRC2000).

VRC5514 pVR1012x/s R5(SA-C)gp140(dCFI)dV4/h

The protein sequence of the envelope polyprotein (gp140delCFI) from 97ZA012 (R5-tropic, GenBank accession number AF286227) was used to create a synthetic version of the gene (Clade-C gp140delCFI) using codons optimized for expression in human cells. The nucleotide sequence R5gp140delCFI shows little homology to the gene 97ZA012, but the protein encoded is the same. The XbaI (18 nt up-stream from ATG) to BamHI (1914 nt down-stream from ATG) fragment which contains polylinker at the 5' end, Kozak sequence and ATG was cloned into the XbaI to BamHI sites of pVR1012x/s backbone. The truncated envelope polyprotein lacks the V4 loop (a.a 385-399), the Fusion and Cleavage (F/CL) domains (a.a.487-520), the Interspace (IS) between Heptad (H) 1 and 2 (a.a.577-605), the transmembrane domain and the intracellular region. Regions important for oligomer formation may be partially functional. Heptad (H) 1, Heptad 2 and their Interspace(IS) are required for oligomerization. The expression vector backbone is pVR1012x/s (VRC2000).

VRC5515 pVR1012x/s R5(SA-C)gp145(dCFI)dV1/h

The protein sequence of the envelope polyprotein (gp145delCFI) from 97ZA012 (R5-tropic, GenBank accession number AF286227) was used to create a synthetic version of the gene (Clade-C gp145delCFI) using codons optimized for expression in human cells. The nucleotide sequence R5gp145delCFI shows little homology to the gene 97ZA012, but the protein encoded is the same. The XbaI (18 nt up-stream from ATG) to BamHI (1914 nt down-stream from ATG) fragment which contains polylinker at the 5' end, Kozak sequence and ATG was cloned into the XbaI to BamHI sites of pVR1012x/s backbone. The truncated envelope polyprotein lacks the V1 loop (a.a.136-150), the Fusion and Cleavage (F/CL) domains (a.a.487-520), the Interspace (IS) between Heptad (H) 1 and 2 (a.a.577-605), and the intracellular region. Regions important for oligomer formation may be partially functional. Heptad(H) 1, Heptad 2 and their Interspace(IS) are required for oligomerization. The expression vector backbone is pVR1012x/s (VRC2000).

VRC5516 pVR1012x/s R5(SA-C)gp145(dCFI)dV12/h

The protein sequence of the envelope polyprotein (gp145delCFI) from 97ZA012 (R5-tropic, GenBank accession number AF286227) was used to create a synthetic version of the gene (Clade-C gp145delCFI) using codons optimized for expression in human cells. The nucleotide sequence R5gp145delCFI shows little homology to the gene 97ZA012, but the protein encoded is the same. The XbaI (18 nt up-stream from ATG) to BamHI (1914 nt down-stream from ATG) fragment which contains polylinker at the 5' end, Kozak sequence and ATG was cloned into the XbaI to BamHI sites of pVR1012x/s backbone. The truncated envelope polyprotein lacks the V1, V2 loops (a.a.136-194), the Fusion and Cleavage (F/CL) domains (a.a.487-520), the Interspace (IS) between Heptad (H) 1 and 2 (a.a.577-605), and the intracellular region. Regions important for oligomer formation may be partially functional. Heptad(H) 1, Heptad 2 and their Interspace(IS) are required for oligomerization. The expression vector backbone is pVR1012x/s (VRC2000).

VRC5517 pVR1012x/s R5(SA-C)gp145(dCFI)dV123/h

The protein sequence of the envelope polyprotein (gp145delCFI) from 97ZA012 (R5-tropic, GenBank accession number AF286227) was used to create a synthetic version of the gene (Clade-C gp145delCFI) using codons optimized for expression in human cells. The nucleotide sequence R5gp145delCFI shows little homology to the gene 97ZA012, but the protein encoded is the same. The XbaI (18 nt up-stream from ATG) to BamHI (1914 nt down-stream from ATG) fragment which contains polylinker at the 5' end, Kozak sequence and ATG was cloned into the XbaI to BamHI sites of pVR1012x/s backbone. The truncated envelope polyprotein lacks the V1, V2, V3 loops (a.a.136-194, 297-325), the Fusion and Cleavage (F/CL) domains (a.a.487-520), the Interspace (IS) between Heptad (H) 1 and 2 (a.a.577-605), and the intracellular region. Regions important for oligomer formation may be partially functional. Heptad(H) 1, Heptad 2 and their Interspace(IS) are required for oligomerization. The expression vector backbone is pVR1012x/s (VRC2000).

VRC5518 pVR1012x/s R5(SA-C)gp145(dCFI)dV1234/h

The protein sequence of the envelope polyprotein (gp145delCFI) from 97ZA012 (R5-tropic, GenBank accession number AF286227) was used to create a synthetic version of the gene (Clade-C gp145delCFI) using codons optimized for expression in human cells. The nucleotide sequence R5gp145delCFI shows little homology to the gene 97ZA012, but the protein encoded is the same. The XbaI (18 nt up-stream from ATG) to BamHI (1914 nt down-stream from ATG) fragment which contains polylinker at the 5' end, Kozak sequence and ATG was cloned into the XbaI to BamHI sites of pVR1012x/s backbone. The truncated envelope polyprotein lacks the V1, V2, V3, V4 loops (a.a.136-194, 297-325, 385-399), the Fusion and Cleavage (F/CL) domains (a.a.487-520), the Interspace (IS) between Heptad (H) 1 and 2 (a.a.577-605), and the intracellular region. Regions important for oligomer formation may be partially functional. Heptad(H) 1, Heptad 2 and their Interspace(IS) are required for oligomerization. The expression vector backbone is pVR1012x/s (VRC2000).

VRC5519 pVR1012x/s R5(SA-C)gp145(dCFI)dV2/h

The protein sequence of the envelope polyprotein (gp145delCFI) from 97ZA012 (R5-tropic, GenBank accession number AF286227) was used to create a synthetic version of the gene (Clade-C gp145delCFI) using codons optimized for expression in human cells. The nucleotide sequence R5gp145delCFI shows little homology to the gene 97ZA012, but the protein encoded is the same. The XbaI (18 nt up-stream from ATG) to BamHI (1914 nt down-stream from ATG) fragment which contains polylinker at the 5' end, Kozak sequence and ATG was cloned into the XbaI to BamHI sites of pVR1012x/s backbone. The truncated envelope polyprotein lacks the V2 loop (a.a.156-194), the Fusion and Cleavage (F/CL) domains (a.a.487-520), the Interspace (IS) between Heptad (H) 1 and 2 (a.a.577-605), and the intracellular region. Regions important for oligomer formation may be partially functional. Heptad(H) 1, Heptad 2 and their Interspace(IS) are required for oligomerization. The expression vector backbone is pVR1012x/s (VRC2000).

VRC5520 pVR1012x/s R5(SA-C)gp145(dCFI)dV23/h

The protein sequence of the envelope polyprotein (gp145delCFI) from 97ZA012 (R5-tropic, GenBank accession number AF286227) was used to create a synthetic version of the gene (Clade-C gp145delCFI) using codons optimized for expression in human cells. The nucleotide sequence R5gp145delCFI shows little homology to the gene 97ZA012, but the protein encoded is the same. The XbaI (18 nt up-stream from ATG) to BamHI (1914 nt down-stream from ATG) fragment which contains polylinker at the 5' end, Kozak sequence and ATG was cloned into the XbaI to BamHI sites of pVR1012x/s backbone. The truncated envelope polyprotein lacks the V2, V3 loops (a.a.156-194, 297-325), the Fusion and Cleavage (F/CL) domains (a.a.487-520), the Interspace (IS) between Heptad (H) 1 and 2 (a.a.577-605), and the intracellular region. Regions important for oligomer formation may be partially functional. Heptad(H) 1, Heptad 2 and their Interspace(IS) are required for oligomerization. The expression vector backbone is pVR1012x/s (VRC2000).

VRC5521 pVR1012x/s R5(SA-C)gp145(dCFI)dV234/h

The protein sequence of the envelope polyprotein (gp145delCFI) from 97ZA012 (R5-tropic, GenBank accession number AF286227) was used to create a synthetic version of the gene (Clade-C gp145delCFI) using codons optimized for expression in human cells. The nucleotide sequence R5gp145delCFI shows little homology to the gene 97ZA012, but the protein encoded is the same. The XbaI (18 nt up-stream from ATG) to BamHI (1914 nt down-stream from ATG) fragment which contains polylinker at the 5' end, Kozak sequence and ATG was cloned into the XbaI to BamHI sites of pVR1012x/s backbone. The truncated envelope polyprotein lacks the V2, V3, V4 loops (a.a.156-194, 297-325, 385-399), the Fusion and Cleavage (F/CL) domains (a.a.487-520), the Interspace (IS) between Heptad (H) 1 and 2 (a.a.577-605), and the intracellular region. Regions important for oligomer formation may be partially functional. Heptad(H) 1, Heptad 2 and their Interspace(IS) are required for oligomerization. The expression vector backbone is pVR1012x/s (VRC2000).

VRC5522 pVR1012x/s R5(SA-C)gp145(dCFI)dV24/h

The protein sequence of the envelope polyprotein (gp145delCFI) from 97ZA012 (R5-tropic, GenBank accession number AF286227) was used to create a synthetic version of the gene (Clade-C gp145delCFI) using codons optimized for expression in human cells. The nucleotide sequence R5gp145delCFI shows little homology to the gene 97ZA012, but the protein encoded is the same. The XbaI (18 nt up-stream from ATG) to BamHI (1914 nt down-stream from ATG) fragment which contains polylinker at the 5' end, Kozak sequence and ATG was cloned into the XbaI to BamHI sites of pVR1012x/s backbone. The truncated envelope polyprotein lacks the V2, V4 loops (a.a.156-194, 385-399), the Fusion and Cleavage (F/CL) domains (a.a.487-520), the Interspace (IS) between Heptad (H) 1 and 2 (a.a.577-605), and the intracellular region. Regions important for oligomer formation may be partially functional. Heptad(H) 1, Heptad 2 and their Interspace(IS) are required for oligomerization. The expression vector backbone is pVR1012x/s (VRC2000).

VRC5523 pVR1012x/s R5(SA-C)gp145(dCFI)dV3/h

The protein sequence of the envelope polyprotein (gp145delCFI) from 97ZA012 (R5-tropic, GenBank accession number AF286227) was used to create a synthetic version of the gene (Clade-C gp145delCFI) using codons optimized for expression in human cells. The nucleotide sequence R5gp145delCFI shows little homology to the gene 97ZA012, but the protein encoded is the same. The XbaI (18 nt up-stream from ATG) to BamHI (1914 nt down-stream from ATG) fragment which contains polylinker at the 5' end, Kozak sequence and ATG was cloned into the XbaI to BamHI sites of pVR1012x/s backbone. The truncated envelope polyprotein lacks the V3 loop (a.a.297-325), the Fusion and Cleavage (F/CL) domains (a.a.487-520), the Interspace (IS) between Heptad (H) 1 and 2 (a.a.577-605), and the intracellular region. Regions important for oligomer formation may be partially functional. Heptad(H) 1, Heptad 2 and their Interspace(IS) are required for oligomerization. The expression vector backbone is pVR1012x/s (VRC2000).

VRC5524 pVR1012x/s R5(SA-C)gp145(dCFI)dV34/h

The protein sequence of the envelope polyprotein (gp145delCFI) from 97ZA012 (R5-tropic, GenBank accession number AF286227) was used to create a synthetic version of the gene (Clade-C gp145delCFI) using codons optimized for expression in human cells. The nucleotide sequence R5gp145delCFI shows little homology to the gene 97ZA012, but the protein encoded is the same. The XbaI (18 nt up-stream from ATG) to BamHI (1914 nt down-stream from ATG) fragment which contains polylinker at the 5' end, Kozak sequence and ATG was cloned into the XbaI to BamHI sites of pVR1012x/s backbone. The truncated envelope polyprotein lacks the V3, V4 loops (a.a.297-325, 385-399), the Fusion and Cleavage (F/CL) domains (a.a.487-520), the Interspace (IS) between Heptad (H) 1 and 2 (a.a.577-605), and the intracellular region. Regions important for oligomer formation may be partially functional. Heptad(H) 1, Heptad 2 and their Interspace(IS) are required for oligomerization. The expression vector backbone is pVR1012x/s (VRC2000).

VRC5525 pVR1012x/s R5(SA-C)gp145(dCFI)dV4/h

The protein sequence of the envelope polyprotein (gp145delCFI) from 97ZA012 (R5-tropic, GenBank accession number AF286227) was used to create a synthetic version of the gene (Clade-C gp145delCFI) using codons optimized for expression in human cells. The nucleotide sequence R5gp145delCFI shows little homology to the gene 97ZA012, but the protein encoded is the same. The XbaI (18 nt up-stream from ATG) to BamHI (1914 nt down-stream from ATG) fragment which contains polylinker at the 5' end, Kozak sequence and ATG was cloned into the XbaI to BamHI sites of pVR1012x/s backbone. The truncated envelope polyprotein lacks the V4 loop (a.a.385-399), the Fusion and Cleavage (F/CL) domains (a.a.487-520), the Interspace (IS) between Heptad (H) 1 and 2 (a.a.577-605), and the intracellular region. Regions important for oligomer formation may be partially functional. Heptad(H) 1, Heptad 2 and their Interspace(IS) are required for oligomerization. The expression vector backbone is pVR1012x/s (VRC2000).

VRC5526 pVR1012x/s R5(SA-C)gp145(dCFI)dV13/h

The protein sequence of the envelope polyprotein (gp145delCFI) from 97ZA012 (R5-tropic, GenBank accession number AF286227) was used to create a synthetic version of the gene (Clade-C gp145delCFI) using codons optimized for expression in human cells. The nucleotide sequence R5gp145delCFI shows little homology to the gene 97ZA012, but the protein encoded is the same. The XbaI (18 nt up-stream from ATG) to BamHI (1914 nt down-stream from ATG) fragment which contains polylinker at the 5' end, Kozak sequence and ATG was cloned into the XbaI to BamHI sites of pVR1012x/s backbone. The truncated envelope polyprotein lacks the V1, V3 loops (a.a.136-150, 297-325), the Fusion and Cleavage (F/CL) domains (a.a.487-520), the Interspace (IS) between Heptad (H) 1 and 2 (a.a.577-605), and the intracellular region. Regions important for oligomer formation may be partially functional. Heptad(H) 1, Heptad 2 and their Interspace(IS) are required for oligomerization. The expression vector backbone is pVR1012x/s (VRC2000).

VRC5527 pVR1012x/s R5(SA-C)gp145(dCFI)dV134/h

The protein sequence of the envelope polyprotein (gp145delCFI) from 97ZA012 (R5-tropic, GenBank accession number AF286227) was used to create a synthetic version of the gene (Clade-C gp145delCFI) using codons optimized for expression in human cells. The nucleotide sequence R5gp145delCFI shows little homology to the gene 97ZA012, but the protein encoded is the same. The XbaI (18 nt up-stream from ATG) to BamHI (1914 nt down-stream from ATG) fragment which contains polylinker at the 5' end, Kozak sequence and ATG was cloned into the XbaI to BamHI sites of pVR1012x/s backbone. The truncated envelope polyprotein lacks the V1, V3, V4 loops (a.a.136-150, 297-325, 385-399), the Fusion and Cleavage (F/CL) domains (a.a.487-520), the Interspace (IS) between Heptad (H) 1 and 2 (a.a.577-605), and the intracellular region. Regions important for oligomer formation may be partially functional. Heptad(H) 1, Heptad 2 and their Interspace(IS) are required for oligomerization. The expression vector backbone is pVR1012x/s (VRC2000).

VRC5528 pVR1012x/s R5(SA-C)gp145(dCFI)dV124/h

The protein sequence of the envelope polyprotein (gp145delCFI) from 97ZA012 (R5-tropic, GenBank accession number AF286227) was used to create a synthetic version of the gene (Clade-C gp145delCFI) using codons optimized for expression in human cells. The nucleotide sequence R5gp145delCFI shows little homology to the gene 97ZA012, but the protein encoded is the same. The XbaI (18 nt up-stream from ATG) to BamHI (1914 nt down-stream from ATG) fragment which contains polylinker at the 5' end, Kozak sequence and ATG was cloned into the XbaI to BamHI sites of pVR1012x/s backbone. The truncated envelope polyprotein lacks the V1, V2, V4 loops (a.a.136-150, 156-194, 385-399), the Fusion and Cleavage (F/CL) domains (a.a.487-520), the Interspace (IS) between Heptad (H) 1 and 2 (a.a.577-605), and the intracellular region. Regions important for oligomer formation may be partially functional. Heptad(H) 1, Heptad 2 and their Interspace(IS) are required for oligomerization. The expression vector backbone is pVR1012x/s (VRC2000).

VRC5529 pVR1012x/s R5(SA-C)gp145(dCFI)dV14/h

The protein sequence of the envelope polyprotein (gp145delCFI) from 97ZA012 (R5-tropic, GenBank accession number AF286227) was used to create a synthetic version of the gene (Clade-C gp145delCFI) using codons optimized for expression in human cells. The nucleotide sequence R5gp145delCFI shows little homology to the gene 97ZA012, but the protein encoded is the same. The XbaI (18 nt up-stream from ATG) to BamHI (1914 nt down-stream from ATG) fragment which contains polylinker at the 5' end, Kozak sequence and ATG was cloned into the XbaI to BamHI sites of pVR1012x/s backbone. The truncated envelope polyprotein lacks the V1, V4 loops (a.a.136-150, 385-399), the Fusion and Cleavage (F/CL) domains (a.a.487-520), the Interspace (IS) between Heptad (H) 1 and 2 (a.a.577-605), and the intracellular region. Regions important for oligomer formation may be partially functional. Heptad(H) 1, Heptad 2 and their Interspace(IS) are required for oligomerization. The expression vector backbone is pVR 1012x/s (VRC2000).

Gag-Pol Plasmids

VRC3900 pVR1012x/s Gag/h

The protein sequence of the gag polyprotein (Pr55, amino acids 1-432) from HXB2 (GenBank accession number K03455) was used to create a synthetic version of the gag gene using codons optimized for expression in human cells. The nucleotide sequence of the synthetic gag gene shows little homology to the HXB2 gene, but the protein encoded is the same. The synthetic gag gene was ligated in frame with sequences encoding the pol polyprotein to produce pGag(fs)Pol/h (VRC4200). The protein sequence of the pol polyprotein (amino acids 3-1003) from NL4-3 (GenBank accession number M19921) was used to create a synthetic version of the pol gene using codons optimized for expression in human cells. To produce a gene that expresses all of the gag proteins, the region encoding pol amino acids 77-1003 were deleted from Gag(fs)Pol/h to produce Gag/h. This construct also encodes most of the protease (98 amino acids) gene encoding amino acids 3-77. Gag/h is expressed from the pVR1012x/s vector backbone.

VRC3901 pVR1012x/s SIV Gag/h

The protein sequence of the gag polyprotein (amino acid from 1-550) SIVmac239 GenBank accession number M33262) was used to create a synthetic version of the gag gene using codons optimized for expression in human cells. The nucleotide sequence of the synthetic gag gene shows little homology to the SIVMac239 gene, but the protein encoded is the same.

VRC4000 pVR1012x/s Gag-Pol/h

The protein sequence of the gag polyprotein (Pr55, amino acids 1-432) from HXB2(GenBank accession number K03455) was used to create a synthetic version of the gag gene using codons optimized for expression in human cells. The nucleotide sequence of the synthetic gag gene shows little homology to the HXB2 gene, but the protein encoded is the same. The synthetic gag gene contains all of the mature Gag proteins except for the last two that are normally cleaved from the carboxy-terminus of the gag polyprotein, p1 and p6 (amino acids 433-500). The synthetic gag gene was ligated in frame with sequences encoding the pol protein. The protein sequence of the pol polyprotein (amino acids 3-1003) from NL4-3 (GenBank accession number M19921) was used to create a synthetic version of the pol gene (Pol/h) using codons optimized for expression in human cells. Gag-Pol/h is expressed from the pVR1012x/s vector backbone.

VRC4001 pVR1012x/s SIVGag-Pol/h

Eukaryotic vector with humanized codons expressing the Gag-pol gene of SIVmac239. The SalI-XbaI fragment of SIV gag(VRC3901) was inserted into SalI-XbaI of SIV Pol (VRC4101) to create VRC4001.

VRC4100 pVR1012x/s Pol/h

The protein sequence of the pol polyprotein (amino acids 3-1003) from NL4-3 (GenBank accession number M19921) was used to create a synthetic version of the pol gene using codons optimized for expression in human cells. To initiate translation at the beginning of Pol, a methionine codon was added to the 5'-end of the synthetic polymerase gene to create the Pol/h gene. Pol/h is expressed from the pVR1012x/s (VRC2000) vector backbone.

VRC4101 pVR1012x/s SIV Pol/h

The protein sequence of the pol polyprotein (amino acids 3-1017) from SIVmac239 (GenBank accession number M19921) was used to create a synthetic version of the pol gene using codons optimized for expression in human cells. To initiate translation at the beginning of Pol, a methionine codon was added to the 5'-end of the synthetic polymerase gene to create the Pol/h gene. The Protease (Pr) mutation is at pol amino acid 123 and is AAG→GGA or amino acids R→G. Reverse transcriptase(RT) mutation is at aa 352(GAC to CAT D(D to H)-RT) and Integrase mutation is at aa 788(GAC to GGC(D to A)-IN). Pol/h is expressed from the pVR1012x/s (VRC2000) vector backbone.

VRC4200 pVR1012x/s Gag(fs)Pol/h

The protein sequence of the gag polyprotein (Pr55, amino acids 1-432) from HXB2 (GenBank accession number K03455) was used to create a synthetic version of the gag gene using codons optimized for expression in human cells. The nucleotide sequence of the synthetic gag gene shows little homology to the HXB2 gene, but the protein encoded is the same. The synthetic gag gene contains all of the mature Gag proteins except for the last two that are normally cleaved from the carboxy-terminus of the gag polyprotein, p1 and p6 (amino acids 433-500). The synthetic gag gene was ligated in frame with sequences encoding the pol polyprotein. The protein sequence of the pol polyprotein (amino acids 3-1003) from NL4-3 (GenBank accession number M19921) was used to create a synthetic version of the pol gene (Pol/h) using codons optimized for expression in human cells. To create the possibility for translational frameshifting as means to express the gag-pol polyprotein, the synthetic coding region for the last four amino acids of the NC protein through the rest of gag plus an additional 3 amino acids from pol were replaced with the corresponding viral sequences (nucleotides 2074-2302 on the HXB2 genome) from NL4-3 (GenBank accession number M19921). The substitution of viral for synthetic sequences both introduces the sites required for frameshifting and restores the ability to express all gag proteins, including p1 and p6. Gag(fs)Pol/h is expressed from the pVR1012x/s vector backbone.

VRC4300 pVR1012 Gag-Pol(d delta RT delta IN)/h

Eukaryotic vector with humanized codons expressing the Gag and the frame shifted Pol genes of HIV HXB2 subtype B with deletions in Reverse transcriptase, and Integrase regions. The protein sequence of the gag polyprotein (Pr55, amino acids 1-432) from HXB2 (GenBank accession number K03455) was used to create a synthetic version of the gag gene using codons optimized for expression in human cells. The nucleotide sequence of the synthetic gag gene shows little homology to the HXB2 gene, but the protein encoded is the same. The synthetic gag gene contains all of the mature Gag proteins except for the last two that are normally cleaved from the carboxy-terminus of the gag polyprotein, p1 and p6 (amino acids 433-500). The synthetic gag gene was ligated in frame with sequences encoding the pol polyprotein. The protein sequence of the pol polyprotein (amino acids 3-1003) from NL4-3 (GenBank accession number M19921) was used to create a synthetic version of the pol gene (Pol/h) using codons optimized for expression in human cells. To create the possibility for translational frameshifting as means to express the gag-pol polyprotein, the synthetic coding region for the last four amino acids of the NC protein through the rest of gag plus an additional 3 amino acids from pol were replaced with the corresponding viral sequences (nucleotides 2074-2302 on the HXB2 genome) from NL4-3 (GenBank accession number M19921). The substitution of viral for synthetic sequences both introduces the sites required for frameshifting and restores the ability to express all gag proteins, including p1 and p6 The Reverse Transcriptase (RT) mutation is at gag-pol amino acid 771 and is GAC→CAC or amino acids D→H. The Integrase (IN) mutation is at gag-pol amino acid 1209 and is ACT→CAT or amino acids D→A. Note: This vector is not in the pVR1012x/s backbone.

VRC4301 pVR1012x/s-Gag(FS)-Pol-delta RT IN-IRES-R5 gp157-Nef

For the Gag(FS)Pol delta RT delta IN/h portion, VRC4302 pVR1012x/s Gag(fs)Pol(delta PR delta/h was used for the protein sequence of the gag polyprotein (Pr55, amino acids 1-432) from HXB2 (GenBank accession number K03455) was used to create a synthetic version of the gag gene using codons optimized for expression in human cells. The nucleotide sequence of the synthetic gag gene shows little homology to the HXB2 gene, but the protein encoded is the same. The synthetic gag gene contains all of the mature Gag proteins except for the last two that are normally cleaved from the carboxy-terminus of the gag polyprotein, p1 and p6 (amino acids 433-500). The synthetic gag gene was ligated in frame with sequences encoding the pol polyprotein. The protein sequence of the pol polyprotein (amino acids 3-1003) from NL4-3 (GenBank accession number M19921) was used to create a synthetic version of the pol gene (Pol/h) using codons optimized for expression in human cells. To create the possibility for translational frameshifting as means to express the gag-pol polyprotein, the synthetic coding region for the last four amino acids of the NC protein through the rest of gag plus an additional 3 amino acids from pol were replaced with the corresponding viral sequences (nucleotides 2074-2302 on the HXB2 genome) from NL4-3 (GenBank accession number M19921). The substitution of viral for synthetic sequences both introduces the sites required for frameshifting and restores the ability to express all gag proteins, including p1 and p6. Gag(fs)Pol/h is expressed from the pVR1012x/s vector backbone. The Reverse Transcriptase (RT) mutation is at gag-pol amino acid 771 and is GAC→CAC or amino acids D→H. The Integrase (IN) mutation is at gag-pol amino acid 1209 and is ACT→CAT or amino acids D→A. This gene has been fused to an Internal Ribosomal Entry Site (IRES) and then fused to the R5gp157-Nef from VRC2200 pVR1012x/s R5gp157-NefDMHCDCD4/h in which the protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, P470L, T723I, and S745T. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The envelope-Nef fusion protein expressed from pR5gp157-Nef/h contains the first 820 amino acids from the HIV envelope glycoprotein (gp157) fused to the entire mutant Nef protein. The gene for gp157 was ligated in frame with the full-length mutant Nef gene from pNefD-MHCDCD4/h (VRC3600) to produce pR5gp157-NefDMH-CDCD4/h. The protein sequence of the Nef protein from HIV-1 PV22 (GenBank accession number K02083) was used to create a synthetic version of the Nef gene (Nef/h) using codons optimized for expression in human cells. To disrupt the ability of Nef to limit both MHC class I and CD4 expression, point mutations were introduced into the Nef gene from pNef/h (VRC3500). The resulting amino acids substitutions in pNefDMHCDCD4/h are: P69A, P72A, P75A, P78A, D174A and D175A. R5gp157-NefDMHCDCD4/h is expressed from the pVR 1012x/s (VRC2000) vector backbone.

VRC4302 pVR1012 Gag(delFS)Pol(delta PR delta RT delta IN)/h

The protein sequence of the gag polyprotein (Pr55, amino acids 1-432) from HXB2 (GenBank accession number K03455) was used to create a synthetic version of the gag gene using codons optimized for expression in human cells. The nucleotide sequence of the synthetic gag gene shows little homology to the HXB2 gene, but the protein encoded is the same. The synthetic gag gene contains all of the mature Gag proteins except for the last two that are normally cleaved from the carboxy-terminus of the gag polyprotein, p1 and p6 (amino acids 433-500). The synthetic gag gene was ligated in frame with sequences encoding the pol polyprotein. The protein sequence of the pol polyprotein (amino acids 3-1003) from NL4-3 (GenBank accession number M19921) was used to create a synthetic version of the pol gene (Pol/h) using codons optimized for expression in human cells. To create the possibility for translational frameshifting as means to express the gag-pol polyprotein, the synthetic coding region for the last four amino acids of the NC protein through the rest of gag plus an additional 3 amino acids from pol were replaced with the corresponding viral sequences (nucleotides 2074-2302 on the HXB2 genome) from NL4-3 (GenBank accession number M19921). The substitution of viral for synthetic sequences both introduces the sites required for frameshifting and restores the ability to express all gag proteins, including p1 and p6. The deleted Frame Shifted (delFS) has 5 T nucleotides deleted between the Gag and Pol sequences. Gag(fs) Pol/h is expressed from the pVR1012x/s vector backbone. The Protease (PR) mutation is at gag-pol amino acid 553 and is AGG→GGC or amino acids R→G. The Reverse Transcriptase (RT) mutation is at gag-pol amino acid 771 and is GAC→CAC or amino acids D→H. The Integrase (IN) mutation is at gag-pol amino acid 1209 and is ACT→CAT or amino acids D→A. Note: This vector is not in the pVR1012x/s backbone.

VRC4303 pVR1012 SIV Gag(delFS)Pol(delta PR delta RT delta IN)/h

Eukaryotic vector with humanized codons expressing the Gag and the frame-shift-deleted Pol genes SIVmac239 with deletions in the Protease, Reverse transcriptase, and Integrase regions. The 5 of Ts from 3188 to 3192 of SIV gag-pol (VRC4001) were deleted to create VRC4303.

VRC4304 pVR1012 Gag (delFS)Pol delta PR delta RT delta IN/h

The protein sequence of the gag polyprotein (Pr55, amino acids 1-432) from HIV-1 C clade(GenBank accession number U52953) was used to create a synthetic version of the gag gene using codons optimized for expression in human cells.

The nucleotide sequence of the synthetic gag gene shows little homology to the HIV-1 gene, but the protein encoded is the same. The synthetic gag gene contains all of the mature Gag proteins except for the last two that are normally cleaved from the carboxy-terminus of the gag polyprotein, p1 and p6 (amino acids 433-500). The synthetic gag gene was ligated in frame with sequences encoding the pol polyprotein. The protein sequence of the pol polyprotein (amino acids 3-1003) from NL4-3 (GenBank accession number M19921) was used to create a synthetic version of the pol gene (Pol/h) using codons optimized for expression in human cells. To create the possibility for translational frameshifting as means to express the gag-pol polyprotein, the synthetic coding region for the last four amino acids of the NC protein through the rest of gag plus an additional 3 amino acids from pol were replaced with the corresponding viral sequences (nucleotides 2074-2302 on the HXB2 genome) from NL4-3 (GenBank accession number M19921). The substitution of viral for synthetic sequences both introduces the sites required for frameshifting and restores the ability to express all gag proteins, including p1 and p6. The deleted Frame Shifted (delFS) has 5 T nucleotides deleted between the Gag and Pol sequences. Gag(fs)Pol/h is expressed from the pVR1012x/s vector backbone. The Protease (PR) mutation is at gag-pol amino acid 553 and is AGG→GGC or amino acids R→G. The Reverse Transcriptase (RT) mutation is at gag-pol amino acid 771 and is GAC→CAC or amino acids D→H. The Integrase (IN) mutation is at gag-pol amino acid 1209 and is ACT→CAT or amino acids D→A. Note: This vector is not in the pVR1012x/s backbone.

VRC4305 pVR1012 Gag-A(delFS)Pol(delta PR delta RT delta IN)/h

Eukaryotic vector with humanized codons expressing the Gag and the frame shifted Pol genes of HIV HIV-1A clade with deletions in the Protease, Reverse transcriptase, and Integrase regions. VRC4305 pVR1012 Gag(-AdelFS)Pol (delta PR delta RT delta IN)/h The protein sequence of the gag polyprotein (Pr55, amino acids 1-432) from HIV-1 A clade (GenBank accession number AF004885) was used to create a synthetic version of the gag gene using codons optimized for expression in human cells. The nucleotide sequence of the synthetic gag gene shows little homology to the HIV-1 gene, but the protein encoded is the same. The synthetic gag gene contains all of the mature Gag proteins except for the last two that are normally cleaved from the carboxy-terminus of the gag polyprotein, p1 and p6 (amino acids 433-500). The synthetic gag gene was ligated in frame with sequences encoding the pol polyprotein. The protein sequence of the pol polyprotein (amino acids 3-1003) from NL4-3 (GenBank accession number M19921) was used to create a synthetic version of the pol gene (Pol/h) using codons optimized for expression in human cells. To create the possibility for translational frameshifting as means to express the gag-pol polyprotein, the synthetic coding region for the last four amino acids of the NC protein through the rest of gag plus an additional 3 amino acids from pol were replaced with the corresponding viral sequences (nucleotides 2074-2302 on the HXB2 genome) from NL4-3 (GenBank accession number M19921). The substitution of viral for synthetic sequences both introduces the sites required for frameshifting and restores the ability to express all gag proteins, including p1 and p6. The deleted Frame Shifted (delFS) has 5 T nucleotides deleted between the Gag and Pol sequences. Gag(fs)Pol/h is expressed from the pVR1012x/s vector backbone. The Protease (PR) mutation is at gag-pol amino acid 553 and is AGG→GGC or amino acids R→G. The Reverse Transcriptase (RT) mutation is at gag-pol amino acid 771 and is GAC→CAC or amino acids D→H. The Integrase (IN) mutation is at gag-pol amino acid 1209 and is ACT→CAT or amino acids D→A. Note: This vector is not in the pVR1012x/s backbone.

pVRC4306 pVR1012 Gag(delFS)Pol delta PR delta RT delta IN/Nef/h

The protein sequence of the Gag polyprotein (Pr55, amino acids 1-432) from HXB2 (GenBank accession number K03455) was used to create a synthetic version of the Gag gene using codons optimized for expression in human cells. The nucleotide sequence of the synthetic Gag gene shows little homology to the HXB2 gene, but the protein encoded is the same. The synthetic Gag gene contains all of the mature Gag proteins except for the last two that are normally cleaved from the carboxy-terminus of the Gag polyprotein, p1 and p6 (amino acids 433-500). The synthetic Gag gene was ligated in frame with sequences encoding the Pol polyprotein. The protein sequence of the Pol polyprotein (amino acids 3-1003) from NL4-3 (GenBank accession number M19921) was used to create a synthetic version of the Pol gene (Pol/h) using codons optimized for expression in human cells. To create the possibility for translational frameshifting as means to express the Gag-Pol polyprotein, the synthetic coding region for the last four amino acids of the NC protein through the rest of Gag plus an additional 3 amino acids from Pol were replaced with the corresponding viral sequences (nucleotides 2074-2302 on the HXB2 genome) from NL4-3 (GenBank accession number M19921). The substitution of viral for synthetic sequences both introduces the sites required for frameshifting and restores the ability to express all Gag proteins, including p1 and p6. The deleted Frame Shifted (delFS) has 5 T nucleotides deleted between the Gag and Pol sequences. The Protease (PR) mutation is at Gag-Pol amino acid 553 and is AGG→GGC or amino acids R→G. The Reverse Transcriptase (RT) mutation is at Gag-Pol amino acid 771 and is GAC→CAC or amino acids D→H. The Integrase (IN) mutation is at Gag-Pol amino acid 1209 and is ACT→CAT or amino acids D→A. The Nef/h gene was fused to downstream of Pol gene of Gag(delFS)Pol(delta PR delta RT delta IN). No loss or extra-amino acid was created by the fusion between Nef and Pol. The ATG of Nef was preserved. The protein sequence of the Nef protein from HIV-1 PV22 (GenBank accession number K02083) was used to create a synthetic version of the Nef gene (Nef/h) using codons optimized for expression in human cells. The nucleotide sequence Nef/h shows little homology to the viral gene, but the protein encoded is the same. Note: This vector is not in the pVR1012x/s backbone.

VRC 4308

VRC4302-myr pVR1012 Gag (delFS) Pol deltaPR deltaRT deltaIN delta-Myr/h

The myristylation site was deleted from pVRC4302. The protein sequence of the gag polyprotein (Pr55, amino acids 1-432) from HXB2 (GenBank accession number K03455) was used to create a synthetic version of the gag gene using codons optimized for expression in human cells. The nucleotide sequence of the synthetic gag gene shows little homology to the HXB2 gene, but the protein encoded is the same. The synthetic gag gene contains all of the mature Gag proteins except for the last two that are normally cleaved from the carboxy-terminus of the gag polyprotein, p1 and p6 (amino acids 433-500). The synthetic gag gene was ligated in frame with sequences encoding the pol polyprotein. The protein sequence of the pol polyprotein (amino acids 3-1003) from NL4-3 (GenBank accession number M19921) was used to create a synthetic version of the pol gene (Pol/h) using codons optimized for expression in human cells. To create the possibility for translational frameshifting as means to express the gag-pol polyprotein, the synthetic coding region for the last four amino acids of the NC protein through the rest of gag plus an additional 3 amino acids from pol were replaced with the corresponding viral sequences (nucleotides 2074-2302 on the HXB2 genome) from NL4-3 (GenBank accession number M19921). The substitution of viral for synthetic sequences both introduces the sites required for frameshifting and restores the ability to express all gag proteins, including p1 and p6. The deleted Frame Shifted (delFS) has 5 T nucleotides deleted between the Gag and Pol sequences. Gag(fs) Pol/h is expressed from the pVR1012x/s vector backbone. The Protease (PR) mutation is at gag-pol amino acid 553 and is AGG→GGC or amino acids R→G. The Reverse Transcriptase (RT) mutation is at gag-pol amino acid 771 and is GAC→CAC or amino acids D→H. The Integrase (IN) mutation is at gag-pol amino acid 1209 and is ACT→CAT or amino acids D→A. The myristylation site was deleted. Note: This vector is not in the pVR1012x/s backbone.

VRC 4309 pVR1012 Gag (delFS) Pol deltaPR deltaRT deltaIN delta Myr/Nef/h

The myristylation site was deleted from pVRC4306. The protein sequence of the gag polyprotein (Pr55, amino acids 1-432) from HXB2 (GenBank accession number K03455) was used to create a synthetic version of the gag gene using codons optimized for expression in human cells. The nucleotide sequence of the synthetic gag gene shows little homology to the HXB2 gene, but the protein encoded is the same. The synthetic gag gene contains all of the mature Gag proteins except for the last two that are normally cleaved from the carboxy-terminus of the gag polyprotein, p1 and p6 (amino acids 433-500). The synthetic gag gene was ligated in frame with sequences encoding the pol polyprotein. The protein sequence of the pol polyprotein (amino acids 3-1003) from NL4-3 (GenBank accession number M19921) was used to create a synthetic version of the pol gene (Pol/h) using codons optimized for expression in human cells. To create the possibility for translational frameshifting as means to express the gag-pol polyprotein, the synthetic coding region for the last four amino acids of the NC protein through the rest of gag plus an additional 3 amino acids from pol were replaced with the corresponding viral sequences (nucleotides 2074-2302 on the HXB2 genome) from NL4-3 (GenBank accession number M19921). The substitution of viral for synthetic sequences both introduces the sites required for frameshifting and restores the ability to express all gag proteins, including p1 and p6. The deleted Frame Shifted (delFS) has 5 T nucleotides deleted between the Gag and Pol sequences. Gag(fs) Pol/h is expressed from the pVR1012x/s vector backbone. The Protease (PR) mutation is at gag-pol amino acid 553 and is AGG→GGC or amino acids R→G. The Reverse Transcriptase (RT) mutation is at gag-pol amino acid 771 and is GAC→CAC or amino acids D→H. The Integrase (IN) mutation is at gag-pol amino acid 1209 and is ACT→CAT or amino acids D→A. The stop codon TAG was removed and synthetic B clade Nef (Genbank access number) was fusion to the 3' end of pol by PCR. Note: This vector is not in the pVR1012x/s backbone.

VRC 4310 pVR1012 Nef Gag (del fs) (del Myr) Pol (delta PR delta RT delta IN)/h

The protein sequence of the gag polyprotein (Pr55, amino acids 1-432) from HXB2 (GenBank accession number K03455) was used to create a synthetic version of the gag gene using codons optimized for expression in human cells. The nucleotide sequence of the synthetic gag gene shows little homology to the HXB2 gene, but the protein encoded is the same. The synthetic gag gene contains all of the mature Gag proteins except for the last two that are normally cleaved from the carboxy-terminus of the gag polyprotein, p1 and p6 (amino acids 433-500). The synthetic gag gene was ligated in frame with sequences encoding the pol polyprotein. The protein sequence of the pol polyprotein (amino acids 3-1003) from NL4-3 (GenBank accession number M19921) was used to create a synthetic version of the pol gene (Pol/h) using codons optimized for expression in human cells. To create the possibility for translational frameshifting as means to express the gag-pol-polyprotein, the synthetic coding region for the last four amino acids of the NC protein through the rest of gag plus an additional 3 amino acids from pol were replaced with the corresponding viral sequences (nucleotides 2074-2302 on the HXB2 genome) from NL4-3 (GenBank accession number M19921). The substitution of viral for synthetic sequences both introduces the sites required for frameshifting and restores the ability to express all gag proteins, including p1 and p6. The deleted Frame Shifted (delFS) has 5 T nucleotides deleted between the Gag and Pol sequences. Gag(fs) Pol/h is expressed from the pVR1012x/s vector backbone. The Protease (PR) mutation is at gag-pol amino acid 553 and is AGG→GGC or amino acids R→G. The Reverse Transcriptase (RT) mutation is at gag-pol amino acid 771 and is GAC→CAC or amino acids D→H. The Integrase (IN) mutation is at gag-pol amino acid 1209 and is ACT→CAT or amino acids D→A. The stop codon TAG of synthetic B clade Nef (Genbank access number) gene was removed and was fused to the 5' end of gene by PCR. Note: This vector is not in the pVR1012x/s backbone.

VRC 4311 pVR1012 Gag-C(delFS)Pol(delta PR delta RT delta IN) Nef/h VRC4304+Clade C Nef

The protein sequence of the gag polyprotein (Pr55, amino acids 1-432) from HIV-1 C clade(GenBank accession number U52953) was used to create a synthetic version of the gag gene using codons optimized for expression in human cells. The nucleotide sequence of the synthetic gag gene shows little homology to the HIV-1 gene, but the protein encoded is the same. The synthetic gag gene contains all of the mature Gag proteins except for the last two that are normally cleaved from the carboxy-terminus of the gag polyprotein, p1 and p6 (amino acids 433-500). The synthetic gag gene was ligated in frame with sequences encoding the pol polyprotein. The protein sequence of the pol polyprotein (amino acids 3-1003) from NL4-3 (GenBank accession number M19921) was used to create a synthetic version of the pol gene (Pol/h) using codons optimized for expression in human cells. To create the possibility for translational frameshifting as means to express the gag-pol polyprotein, the synthetic coding region for the last four amino acids of the NC protein through the rest of gag plus an additional 3 amino acids from pol were replaced with the corresponding viral sequences (nucleotides 2074-2302 on the HXB2 genome) from NL4-3 (GenBank accession number M19921). The substitution of viral for synthetic sequences both introduces the sites required for frameshifting and restores the ability to express all gag proteins, including p1 and p6. The deleted Frame Shifted (delFS) has 5 T nucleotides deleted between the Gag and Pol sequences. Gag(fs)Pol/h is expressed from the pVR1012x/s vector backbone. The Protease (PR) mutation is at gag-pol amino acid 553 and is AGG→GGC or amino acids R→G. The Reverse Transcriptase (RT) mutation is at gag-pol amino acid 771 and is GAC→CAC or amino acids D→H. The Integrase (IN) mutation is at gag-pol amino acid 1209 and is ACT→CAT or amino acids D→A. The stop codon TAG was removed and synthetic C clade Nef (Genbank accession number:U52953) was fusion to the 3' end of pol by PCR. Note: This vector is not in the pVR1012x/s backbone.

VRC 4312

Gag (del fs) (del Myr) Nef Pol ΔPRΔRTΔIN/h

VRC-Myr-gag-Dnef-Dpol (Eukaryotic vector with humanized codons expressing the Gag, truncated Nef, and truncated Pol proteins of HIV subtype B .ns.)

This construct was derived from VRC4302. The protein sequence of the gag polyprotein (Pr55, amino acids 1-432) from HXB2 (GenBank accession number K03455) was used to create a synthetic version of the gag gene using codons optimized for expression in human cells. The nucleotide sequence of the synthetic gag gene shows little homology to the HXB2 gene, but the protein encoded is the same. The synthetic gag gene contains all of the mature Gag proteins except for the last two that are normally cleaved from the carboxy-terminus of the gag polyprotein, p1 and p6 (amino acids 433-500). The synthetic gag gene was ligated in frame with sequences encoding synthetic nef gene that 51 aa were deleted from 5'. 77 aa were deleted from 5' of pol polyprotein, and ligated with 3' of nef in which tag stop codon was deleted. The protein sequence of the pol polyprotein (amino acids 3-78-1003) from NL4-3 (GenBank accession number M19921) was used to create a synthetic version of the pol gene (Pol/h) using codons optimized for expression in human cells. To create the possibility for translational frameshifting as means to express the gag-pol polyprotein, the synthetic coding region for the last four amino acids of the NC protein through the rest of gag plus an additional 3 amino acids from pol were replaced with the corresponding viral sequences (nucleotides 2074-2302 on the HXB2 genome) from NL4-3 (GenBank accession number M19921). The substitution of viral for synthetic sequences both introduces the sites required for frameshifting and restores the ability to express all gag proteins, including p1 and p6. The deleted Frame Shifted (delFS) has 5 T nucleotides deleted between the Gag and Pol sequences. Gag(fs)Pol/h is expressed from the pVR1012x/s vector backbone. The Protease (PR) mutation is at gag-pol amino acid 553 and is AGG→GGC or amino acids R→G. The Reverse Transcriptase (RT) mutation is at gag-pol amino acid 771 and is GAC→CAC or amino acids D→H. The Integrase (IN) mutation is at gag-pol amino acid 1209 and is ACT→CAT or amino acids D→A. Note: This vector is not in the pVR1012x/s backbone.

VRC 4313 pVR1012 Gag Clade A (del fs)Pol(Δ PR Δ RT Δ IN)/h VRC4305+Clade A Nef

The protein sequence of the gag polyprotein (Pr55, amino acids 1-432) from HIV-1 A clade (GenBank accession number AF004885) was used to create a synthetic version of the gag gene using codons optimized for expression in human cells. The nucleotide sequence of the synthetic gag gene shows little homology to the HIV-1 gene, but the protein encoded is the same. The synthetic gag gene contains all of the mature Gag proteins except for the last two that are normally cleaved from the carboxy-terminus of the gag polyprotein, p1 and p6 (amino acids 433-500). The synthetic gag gene was ligated in frame with sequences encoding the pol polyprotein. The protein sequence of the pol polyprotein (amino acids 3-1003) from NL4-3 (GenBank accession number M19921) was used to create a synthetic version of the pol gene (Pol/h) using codons optimized for expression in human cells. To create the possibility for translational frameshifting as means to express the gag-pol polyprotein, the synthetic coding region for the last four amino acids of the NC protein through the rest of gag plus an additional 3 amino acids from pol were replaced with the corresponding viral sequences (nucleotides 2074-2302 on the HXB2 genome) from NL4-3 (GenBank accession number M19921). The substitution of viral for synthetic sequences both introduces the sites required for frameshifting and restores the ability to express all gag proteins, including p1 and p6. The deleted Frame Shifted (delFS) has 5 T nucleotides deleted between the Gag and Pol sequences. Gag(fs)Pol/h is expressed from the pVR1012x/s vector backbone. The Protease (PR) mutation is at gag-pol amino acid 553 and is AGG→GGC or amino acids R→G. The Reverse Transcriptase (RT) mutation is at gag-pol amino acid 771 and is GAC→CAC or amino acids D→H. The Integrase (IN) mutation is at gag-pol amino acid 1209 and is ACT→CAT or amino acids D→A. The stop codon TAG was removed and synthetic A clade Nef (Genbank accession number:AF069670) was fused to the 3' end of pol by PCR. Note: This vector is not in the pVR1012x/s backbone.

EXAMPLES

Env

Immunogens

Plasmids expressing the CXCR4-tropic HIV-1 HXB2 Env were made synthetically with sequences designed to disrupt viral RNA structures that limit protein expression by using codons typically found in human cells. Briefly, the synthetic Env gene of HXB2 (GenBank accession number K03455) was generated in three fragments by assembling the overlapping synthetic oligonucleotides using PCR amplification. To produce a CCR5-tropic version of the HIV-1 envelope, the region encoding amino acids 275 to 361 of HXB2 (CXCR4-tropic) gp160 was replaced with CCR5-tropic HIV-1 BaL sequence (GenBank accession number M68893), which includes the V3 loop. Glycosylation mutants were generated by site-directed mutagenesis to replace asparagine with glutamic acid residues at seventeen conserved glycosylation sites between amino acids 88 and 448. To express truncation mutant Env proteins, stop codons were introduced after positions 752, 704, 680 or 592 to produce gp150, gp145, gp140, or gp128, respectively. The Env protein was further changed by deleting amino acids 503 to 537 and 593 to 619, which removes the cleavage site sequence, the fusion domain, and a part of the spacer between the two heptad repeats. The structures of the synthetic HIV envelope genes are shown (FIG. 178). The cDNAs were cloned in the expression vector pNGVL or pVR1012 under the control of the cytomegalovirus immediate-early enhancer, promoter, and first intron. The protein sequence was identical to HXB2 Env except for the following amino acid substitutions: F53L, N94D, K192S, I215N, A224T, A346D, P470L, T723I, and S745T.

Expression of Envelope Proteins in Transfected Cells 293 cells ($10^6$) were plated in 60 mm dishes. Cells were transfected on the following day with 2 µg of plasmid using calcium phosphate. Cells were harvested 48 hours after transfection and lysed in buffer containing 50 mM HEPES pH 7.0, 250 mM NaCl and 0.5% NP40. The protein concentration in the lysates was determined using the Bradford reagent (Bio-Rad). Proteins (25 µg) in lysates were separated by 7.5% SDS-PAGE and transferred to Immobilon-P membrane (Millipore, Bedford, Mass.). Env was detected by immunoprecipitation followed by Western blotting using polyclonal antibody against gp160 (Intracel, Rockville, Md.).

Cell Surface Expression of Envelope by FACS Analysis 293 cells were harvested 48 hours after transfection and washed twice with phosphate-buffered saline (PBS) containing 1% bovine serum albumin and incubated for 30 minutes on ice with polyclonal immunoglobulin from an HIV-1 infected patient. The secondary antibody against human IgG conjugated with FITC (Jackson Immuno Research) was added, incubated for 30 minutes on ice, washed 3 times with PBS, and analyzed by flow cytometry (FACScan). The median fluorescence intensity values were derived using Cell Quant software.

DNA Injection in Mice

Six week old, female BALB/c mice were injected intramuscularly with 100 µg of purified plasmid DNA suspended in 200 µl of normal saline. For each plasmid DNA, a group of 4 mice was injected three times at intervals of two weeks. The mice were bled two weeks after the last injection, sera collected and stored at 4° C.

Quantitation of the Antibody Response

Immunoprecipitation and Western blotting was used to detect the antibodies that bind to native envelope proteins. Sera from immunized mice were used to immunoprecipitate gp160 from cell lysates of gp160-transfected 293 cells. Indicated dilutions were used to immunoprecipitate gp160 from the cell lysate (400 µg). Immunocomplexes were separated by 7.5% SDS-PAGE and analyzed by immunoblotting using the polyclonal antibody against gp160.

Analysis of CTL Response

Spleens were removed aseptically and gently homogenized to a single cell suspension, washed, and resuspended to a final concentration of $5\times10^7$ cells/ml. Cells were incubated for 7 days in presence of IL-2 (10 U/ml) and either irradiated peptide-pulsed splenocytes from naive mice or an irradiated stable cell line expressing the full length gp160 BC-env/rev. Three types of target cells were used: peptide-pulsed P815 cells (ATCC TIB64), BC10ME cells stably expressing gp160, and BC10ME cells pulsed with peptides derived from gp160 sequence. Target cells were labeled with $^{51}$Cr for 90 minutes and washed three times with RPMI-1640 with 10% FBS, 2 mM glutamine, $5\times10^{-5}$M β-mercaptoethanol and fungisone, 250 units/ml, and resuspended in this media. Cytolytic activity was determined in triplicate samples using all different target cell dilutions in a 5-hour $^{51}$Cr-release assay.

Gag and Pol

Development of Synthetic HIV-1 Gag-Pol Expression Vectors

The protein sequences of Gag (amino acids 1-432) from HXB2 (GenBank accession number K03455) and Pol (amino acids 3-1003) from NL4-3 (GenBank accession number M19921) were reverse translated by the GCG Package (Genetic Computer Group, Inc., Madison, Wis.) using codons expected for human cells. A 226-bp fragment spanning the frame shift site and the overlapping region of the two reading frames from NL4-3 were retained to allow expression of Gag and Gag-Pol precursor polyproteins in the same construct. 86 oligonucleotides covering 4325 DNA base pairs with 5' SalI and 3' EcoRI sites were purchased from GIBCO Life Technologies. Each of the oligonucleotides was 75 base-pairs with 25 nt of overlap. The codon optimized Gag-Pol gene (hGag-Pol) was assembled by PCR with Pwo (Boehringer Mannheim) and Turbo Pfu (Stratagene) high fidelity DNA polymerase. The PCR conditions were optimized with a PCR optimization kit (Stratagene) on a gradient Robocycler (Stratagene). Full-length synthetic Gag-Pol gene was cloned into the Sal I and blunted Bgl II site of the mammalian expression vector pNGVL-3 (Xu, Ling et al., 1998, Nature Medicine, 4: 37-42) and confirmed by DNA sequencing. Three additional constructs were derived from the hGag-Pol gene. 5 Thymidines (Ts) in the frame shift site (FS) of the hGag-Pol gene were deleted (ΔFS) and the protease was inactivated by replacing AGG in protease to GGC(R42G) to create hGag-PolΔFSΔPr. 432 amino acids of the NH2-terminal of hGag-Pol gene were deleted and an ATG start codon was added to create the hPol gene. 925 amino acids of the COOH-terminal hGag-Pol were deleted to create the hGag gene. hGag-PolΔFSΔPr, hPol and hGag genes were expressed in the pNGVL-3 plasmid, derived by insertion of a polylinker into pVR1012. The plasmid expressing viral Gag-Pol, pCMVΔ8.2 was a kind gift.

Transient Transfection and Analysis of Expression 293T cells were maintained in Dulbecco's modified Eagle medium (DMEM; GIBCO-BRL), supplemented with 10% fetal bovine serum (FBS). Plasmid DNAs were purified with double cesium chloride sedimentation gradients. Approximately $3\times10^6$ 293T cells were placed in a 10-cm dish one day before transfection. 10 µg of pCMVdR8.2 plasmid (containing the viral gag-pol gene), or 5 µg of pVR1012s (containing the codon altered genes), were used to transfect 293T cells, using the calcium phosphate method. Three days after transfection, cell lysates were prepared with RIPA buffer (Boehringer Mannheim, Indianapolis, Ind.) and separated by 4-15% gradient SDS-polyacrylamide gel electrophoresis (PAGE), then transferred onto an Immobilon P membrane (Millipore). Membranes were then incubated with anti HIV-1-IgG (AIDS Research and Reference Reagent Program), monoclonal anti-p24 (ICN), or rabbit anti-RT (Intracel, Rockville, Md.). Bands were visualized using the ECL Western blotting detection reagent (Amersham Pharmacia Biotech, Piscataway, N.J.), as described by the manufacturer. Expression levels were determined using a phosphorimager.

Generation of Stably Transfected Cell Lines hGag and hPol genes were individually subcloned into the Xho I and EcoRI sites of a retroviral vector, pPGS-CITE-Neo. Three plasmid systems were used to produce recombinant retroviruses containing the hGag or hPol genes. 48 hours after transfection, the supernatants were collected to transduce CT26 and BC10ME which are syngeneic to Balb/C mice, and selected in 0.8 mg/ml of G418 two days after infection. The positive clones were screened and confirmed by Western blotting and maintained in 10% FCS supplemented RPMI (GIBCO-BRL) with 0.5 mg/ml G418.

DNA Vaccination of Mice

Female BALB/C mice, 6-8 weeks old, were used for immunogenicity studies. For DNA vaccination, mice were immunized with 100 μl (0.5 μg/ml DNA and 0.9% NaCl) in the quadriceps muscle of each hind leg every two weeks for a total of 4 injections.

CTL Assay

Animals were sacrificed after the last immunization and spleens removed from both naïve and immunized mice using aseptic techniques. Splenic lymphocytes were harvested and the chromium release CTL assay was performed in triplicate as previously described. The peptides used for sensitizing cells are as follows: Two peptide mixtures from the Gag protein P17(88-115) and p24(62-76). Seven peptide mixtures from the Pol protein: 1) P66(175-189), 2) P66(179-193), 3) P66(183-197), 4) P66(187-201), 5) P66(223-237), 6) P66 (227-241), 7) P66(367-381).

Measurement of Antibody Responses

Anti-p24 ELISA Assays

The anti-p24 ELISA assay was performed in Immunlon ninety-six-well plates (Dynet Technologies Inc., Chantilly, Va.). The plates were coated with 50 μl of purified recombinant HIV-1IIIB p24 antigen (Intracel) at a concentration of 2 μg/ml in PBS buffer, pH 7.4 (GIBCO) with 0.05% sodium azide. Plates were washed 3× in PBS containing 3% BSA and 0.05% Tween20 (blocking buffer) and incubated for 2 hours. Mouse sera were serially diluted from 1:100 to 1:12,800 in blocking buffer, added to the p24-coated plates and incubated overnight at 4° C. Plates were then washed four times with PBS (0.05% Tween 20), and incubated with goat anti-mouse IgG (1:10,000 dilution, Sigma) for 2 hours at room temperature. Plates were washed four times, and then pNPP alkaline phosphatase substrate (75 μl; Sigma, St. Louis, Mo.) was added to each well. The reaction was stopped after one hour by addition of 0.5 N NaOH (25 μl). The plates were read on an ELISA reader at 405 nm, and titers were calculated at a cutoff optical density of 0.4.

HIV-1 immunoblotting

The strips containing HIV-1 proteins (Immunectics Inc., Cambridge, Mass.) were incubated with pooled mouse sera at a dilution of 1:25. Purified human anti-HIV IgG (AIDS Research and Reference Reagent Program, Rockville, Md.) was used as a positive control. Bands were visualized using the ECL Western blotting detection reagent (Amersham Pharmacia Biotech, Piscataway, N.J.).

Immunoprecipitation and Western Blotting

Three days after transfection, hPol gene-transfected 293T cell lysates were prepared with RIPA buffer. The pooled mouse sera were diluted with immunoprecipitation (IP) buffer (100 mM KCl, 2.5 mM $MgCl_2$, 20 mM HEPES, pH 7.9, 0.1% NP-40, 1 mM DTT and proteinase inhibitors). After adding 10 μg of the cell lysate containing the HIV-1 Pol protein, the reactions were incubated overnight on a rotator at 4° C. 250 μl of Protein G and A Sepharose beads (10% V/V in IP buffer) were then added, and the reactions were incubated for 2 hours on a rotator at 4° C. The beads were washed four times with IP buffer, resuspended in 30 μl of 1× sample buffer and loaded onto SDS-PAGE. After transfer onto an Immobilon P membrane (Millipore), membranes were incubated with anti HIV-1-IgG (AIDS Research and Reference Reagent Program). Bands were visualized using the ECL Western blotting detection reagent (Amersham Pharmacia Biotech).

Prime/Boost Vaccination Strategy

Groups of guinea pigs (4/group) were immunized (primed) with the vectors listed below, 3 times at 2 week intervals. Two weeks after the third DNA immunization, blood was collected for immune analysis. 2-3 days after the blood collection, the animals received a boost with a corresponding adenoviral construct, AdApt (Sullivan, N. et al., 2000, Nature, 408: 605-608). Blood was again collected 2 weeks after the adenoviral boost. Blood was tested for neutralizing antibodies and (using an ELISA) the presence of antibody against the envelope. The groups are summarized below.

| Prime | Adenoviral Boost |
|---|---|
| gp140delCFI (R5) | Adv gp140delCFI(R5) |
| gp145delCFI (R5) | Adv gp145delCFI(R5) |
| gp145delCFI (R5) | Adv gp140delCFI(R5) |
| gp140delCFI (89.6P) | Adv gp140delCFI(89.6P) |
| gp145delCFI (89.6P) | Adv gp145delCFI(89.6P) |
| gp145delCFI (89.6P) | Adv gp140delCFI(89.6P) |
| Adv gp140delCFI (R5) | Adv gp140delCFI(R5) |
| Adv gp145delCFI (R5) | Adv gp145delCFI(R5) |
| Adv gp145delCFI (R5) | Adv gp140delCFI(R5) |
| Adv gp140delCFI (89.6P) | Adv gp140delCFI(89.6P) |
| Adv gp145delCFI (89.6P) | Adv gp145delCFI(89.6P) |
| Adv gp145delCFI (89.6P) | Adv gp140delCFI(89.6P) |

RESULTS

The level of antibody in the sera after adenoviral boost was 8- to 10-fold higher than the level of antibody present after 3 injections of DNA alone, in almost all of the cases. Nuetralizing antibodies were detected in the sera of animals immunized with either gp145delCFI DNA or gp140delCFI DNA followed by Advgp140delCFI.

Neutralization was also observed in animals immunized with gp145delCFI DNA followed by Adv gp145delCFI, and in animals both primed and boosted with adenovirus.

Optimal neutralization was seen when animals were primed with gp145delCFI DNA followed by adenovirus expressing gp140delCFI in both clade B (R5-Bal strain) and 89.6P (Clade B, dual tropic strain).

All neutralizing activity was able to be blocked with the V3 peptide of the corresponding strains.

While the present invention has been described in some detail for purposes of clarity and understanding, one skilled in the art will appreciate that various changes in form and detail can be made without departing from the true scope of the invention. All figures, tables, and appendices, as well as patents, applications and publications referred to above are hereby incorporated by reference.

SEQUENCE LISTING (176 sequences)

SEQ ID NO: 1 - DNA, 7547 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcaccatcctgaagtgcaaggacaagaagttcaacggcaagggcccctgcaccaacgtgagcaccgtgcagtgcacccacggcatccgccccgtggtgagcacccagctgctgctgaacgaccgcctggccgaggaggaggtggtgatccgcagcgccaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgcctgggcggcggcgacatgcgcgacaactggcgcagcgagctgtacaagtacaaggtggtgaagatcgagcccctgggcgtggcccccaccaaggccaagcgccgcgtggtgcagcgcgagaagcgcgccgtgggcatcggcgccctgttcctgggcttcctgggcgccgccggcagcaccatgggcgccgccagcatgaccctgaccgtgcaggcccgccagctgctgagcggcatcgtgcagcagcagaacaacctgctgcgcgccatcgaggcccagcagcacctgctgcagctgaccgtgtggggcatcaagcagctgcaggcccgcatcctggccgtggagcgctacctgaaggaccagcagctgctgggcatctggggctgcagcggcaagcttatctgcaccaccgccgtgccctggaacgccagctggagcaacaagagcctggagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcatgggcggcaagtggagcaagagcagcgtgatcggctggcccgccgtgcgcgagcgcatgcgccgcgccgagcccgccgccgacggcgtgggcgccgtgagccgcgacctggagaagcacggcgccatcaccagcagcaacaccgccgccaacaacgccgcctgcgcctggctggaggcccaggaggaggaggaggtgggcttcgcagtgaccgcacaggtggcactgcgcgcaatgacctacaaggccgccgtggacctgagccacttcctgaaggagaagggcggcctggagggcctgatccacagccagcgccgccaggacatcctggacctgtggatctaccacacccagggctacttccccgactggcagaactacacccccggccccggcgtgcgctaccccctgaccttcggctggtgctacaagctggtgcccgtggagcccgacaaggtggaggaggccaacaagggcgagaacaccagcctgctgcaccccgtgagcctgcacggcatggcagcacccgagcgcgaggtgctggagtggcgcttcgacagccgcctggccttccaccacgtggcccgcgagctgcaccccgagtacttcaagaactgctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 2 - DNA, 8009 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcaccatcctgaagtgcaaggacaagaagttcaacggcaagggcccctgcaccaacgtgagcaccgtgcagtgcacccacggcatccgccccgtggtgagcacccagctgctgctgaacgaccgcctggccgaggaggaggtggtgatccgcagcgccaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgcctgggcggcggcgacatgcgcgacaactggcgcagcgagctgtacaagtacaaggtggtgaagatcgagcccctgggcgtggcccccaccaaggccaagcgccgcgtggtgcagcgcgagaagcgcgccgtgggcatcggcgccctgttcctgggcttcctgggcgccgccggcagcaccatgggcgccgccagcatgaccctgaccgtgcaggcccgccagctgctgagcggcatcgtgcagcagcagaacaacctgctgcgcgccatcgaggcccagcagcacctgctgcagctgaccgtgtggggcatcaagcagctgcaggcccgcatcctggccgtggagcgctacctgaaggaccagcagctgctgggcatctggggctgcagcggcaagcttatctgcaccaccgccgtgccctggaacgccagctggagcaacaagagcctggagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatcgtgaaccgcgtgcgccagggctacagccccctgagcttccagacccacctgcccatcccccgcggccccgaccgccccgagggcatcgaggaggagggcggcgagcgcgaccgcgaccgcacgatccgcctggtgaacggcagcctggccctgatctgggacgacctgcgcagcctgtgcctgttcagctaccaccgcctgcgcgacctgctgctgatcgtgacccgcatcgtggagctgctgggccgccgcggctgggaggccctgaagtactggtggaacctgctgcagtactggagccaggagctgaagaacagcgccgtgagcctgctgaacgccaccgccatcatgggcggcaagtggagcaagagcagcgtgatcggctggcccgccgtgcgcgagcgcatgcgccgcgccgagcccgccgccgacggcgtgggcgccgtgagccgcgacctggagaagcacggcgccatcaccagcagcaacaccgccgccaacaacgccgcctgcgcctggctggaggcccaggaggaggaggaggtgggcttcgcagtgaccgcacaggtggcactgcgcgcaatgacctacaaggccgccgtggacctgagccacttcctgaaggagaagggcggcctggagggcctgatccacagccagcgccgccaggacatcctggacctgtggatctaccacacccagggctacttccccgactggcagaactacacccccggccccggcgtgcgctaccccctgaccttcggctggtgctacaagctggtgcccgtggagcccgacaaggtggaggaggccaacaagggcgagaacaccagcctgctgcaccccgtgagcctgcacggcatggcagcacccgagcgcgaggtgctggagtggcgcttcgacagccgcctggccttccaccacgtggcccgcgagctgcaccccgagtacttcaagaactgctgaggatccggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 3 - DNA, 7558 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcaccatcctgaagtgcaacaacaagaccttcaacggcaccggcccctgcaccaacgtgagcaccgtgcagtgcacccacggcatccgccccgtggtgagcacccagctgctgctgaacggcagcctggccgaggaggaggtggtgatccgcagcgtgaacttcaccgacaacgccaagaccatcatcgtgcagctgaacaccagcgtggagatcaactgcacccgccccaacaacaacacccgcaagcgaattcgcatccagcgcggccccggccgcgccttcgtgaccatcggcaagatcggcaacatgcgccaggcccactgcaacatcagccgcgccaagtggaacaacaccctgaagcagatcgacagcaagctgcgcgagcagttcggcaacaacaagaccatcatcttcaagcagagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgcctgggcggcggcgacatgcgcgacaactggcgcagcgagctgtacaagtacaaggtggtgaagatcgagcccctgggcgtggcccccaccaaggccaagcgccgcgtggtgcagcgcgagaagcgcgccgtgggcatcggcgccctgttcctgggcttcctgggcgccgccggcagcaccatgggcgccgccagcatgaccctgaccgtgcaggcccgccagctgctgagcggcatcgtgcagcagcagaacaacctgctgcgcgccatcgaggcccagcagcacctgctgcagctgaccgtgtggggcatcaagcagctgcaggcccgcatcctggccgtggagcgctacctgaaggaccagcagctgctgggcatctggggctgcagcggcaagcttatctgcaccaccgccgtgccctggaacgccagctggagcaacaagagcctggagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcatgggcggcaagtggagcaagagcagcgtgatcggctggcccgccgtgcgcgagcgcatgcgccgcgccgagcccgccgccgacggcgtgggcgccgtgagccgcgacctggagaagcacggcgccatcaccagcagcaacaccgccgccaacaacgccgcctgcgcctggctggaggcccaggaggaggaggaggtgggcttcgcagtgaccgcacaggtggcactgcgcgcaatgacctacaaggccgccgtggacctgagccacttcctgaaggagaagggcggcctggagggcctgatccacagccagcgccgccaggacatcctggacctgtggatctaccacacccagggctacttccccgactggcagaactacacccccggccccggcgtgcgctaccccctgaccttcggctggtgctacaagctggtgcccgtggagcccgacaaggtggaggaggccaacaagggcgagaacaccagcctgctgcaccccgtgagcctgcacggcatggcagcacccgagcgcgaggtgctggagtggcgcttcgacagccgcctggccttccaccacgtggcccgcgagctgcaccccgagtacttcaagaactgctgaggatccggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 4 - DNA, 7351 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcaccatcctgaagtgcaacaacaagaccttcaacggcaccggcccctgcaccaacgtgagcaccgtgcagtgcacccacggcatccgccccgtggtgagcacccagctgctgctgaacggcagcctggccgaggaggaggtggtgatccgcagcgtgaacttcaccgacaacgccaagaccatcatcgtgcagctgaacaccagcgtggagatcaactgcacccgccccaacaacaacacccgcaagcgaattcgcatccagcgcggccccggccgcgccttcgtgaccatcggcaagatcggcaacatgcgccaggcccactgcaacatcagccgcgccaagtggaacaacaccctgaagcagatcgacagcaagctgcgcgagcagttcggcaacaacaagaccatcatcttcaagcagagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgcctgggcggcggcgacatgcgcgacaactggcgcagcgagctgtacaagtacaaggtggtgaagatcgagcccctgggcgtggcccccaccaaggccaagcgccgcgtggtgcagcgcgagaagcgcgccgtgggcatcggcgccctgttcctgggcttcctgggcgccgccggcagcaccatgggcgccgccagcatgaccctgaccgtgcaggcccgccagctgctgagcggcatcgtgcagcagcagaacaacctgctgcgcgccatcgaggcccagcagcacctgctgcagctgaccgtgtggggcatcaagcagctgcaggcccgcatcctggccgtggagcgctacctgaaggaccagcagctgctgggcatctggggctgcagcggcaagcttggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 5 - DNA, 8008 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcaccatcctgaagtgcaacaacaagaccttcaacggcaccggcccctgcaccaacgtgagcaccgtgcagtgcacccacggcatccgccccgtggtgagcacccagctgctgctgaacggcagcctggccgaggaggaggtggtgatccgcagcgtgaacttcaccgacaacgccaagaccatcatcgtgcagctgaacaccagcgtggagatcaactgcacccgccccaacaacaacacccgcaagcgaattcgcatccagcgcggccccggccgcgccttcgtgaccatcggcaagatcggcaacatgcgccaggcccactgcaacatcagccgcgccaagtggaacaacaccctgaagcagatcgacagcaagctgcgcgagcagttcggcaacaacaagaccatcatcttcaagcagagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgcctgggcggcggcgacatgcgcgacaactggcgcagcgagctgtacaagtacaaggtggtgaagatcgagcccctgggcgtggcccccaccaaggccaagcgccgcgtggtgcagcgcgagaagcgcgccgtgggcatcggcgccctgttcctgggcttcctgggcgccgccggcagcaccatgggcgccgccagcatgaccctgaccgtgcaggcccgccagctgctgagcggcatcgtgcagcagcagaacaacctgctgcgcgccatcgaggcccagcagcacctgctgcagctgaccgtgtggggcatcaagcagctgcaggcccgcatcctggccgtggagcgctacctgaaggaccagcagctgctgggcatctggggctgcagcggcaagcttatctgcaccaccgccgtgccctggaacgccagctggagcaacaagagcctggagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatcgtgaaccgcgtgcgccagggctacagccccctgagcttccagacccacctgcccatcccccgcggccccgaccgccccgagggcatcgaggaggagggcggcgagcgcgaccgcgaccgcacgatccgcctggtgaacggcagcctggccctgatctgggacgacctgcgcagcctgtgcctgttcagctaccaccgcctgcgcgacctgctgctgatcgtgacccgcatcgtggagctgctgggccgccgcggctgggaggccctgaagtactggtggaacctgctgcagtactggagccaggagctgaagaacagcgccgtgagcctgctgaacgccaccgccatcatgggcggcaagtggagcaagagcagcgtgatcggctggcccgccgtgcgcgagcgcatgcgccgcgccgagcccgccgccgacggcgtgggcgccgtgagccgcgacctggagaagcacggcgccatcaccagcagcaacaccgccgccaacaacgccgcctgcgcctggctggaggcccaggaggaggaggaggtgggcttcgcagtgaccgcacaggtggcactgcgcgcaatgacctacaaggccgccgtggacctgagccacttcctgaaggagaagggcggcctggagggcctgatccacagccagcgccgccaggacatcctggacctgtggatctaccacacccagggctacttccccgactggcagaactacacccccggccccggcgtgcgctaccccctgaccttcggctggtgctacaagctggtgcccgtggagcccgacaaggtggaggaggccaacaagggcgagaacaccagcctgctgcaccccgtgagcctgcacggcatggcagcacccgagcgcgaggtgctggagtggcgcttcgacagccgcctggccttccaccacgtggcccgcgagctgcaccccgagtacttcaagaactgctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 6 - DNA, 6970 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgttctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccatccactactgcgcccccgccggcttcgccatcctgaagtgcaacaacaagaccttcaacggcaccggcccctgcaccaacgtgagcaccgtgcagtgcacccacggcatccgccccgtggtgagcacccagctgctgctgaacggcagcctggccgaggaggaggtggtgatccgcagcgtgaacttcaccgacaacgccaagaccatcatcgtgcagctgaacaccagcgtggagatcaactgcacccgccccaacaacaacacccgcaagcgaattcgcatccagcgcggccccggccgcgccttcgtgaccatcggcaagatcggcaacatgcgccaggcccactgcaacatcagccgcgccaagtggaacaacaccctgaagcagatcgacagcaagctgcgcgagcagttcggcaacaacaagaccatcatcttcaagcagagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgcctgggcggcggcgacatgcgcgacaactggcgcagcgagctgtacaagtacaaggtggtgaagatcgagcccctgggcgtggcccccaccaaggccaagcgccgcgtggtgcagcgcgagaagcgcgccgtgggcatcggcgccctgttcctgggcttcctgggcgccgccggcagcaccatgggcgccgccagcatgaccctgaccgtgcaggcccgccagctgctgagcggcatcgtgcagcagcagaacaacctgctgcgcgccatcgaggcccagcagcacctgctgcagctgaccgtgtggggcatcaagcagctgcaggcccgcatcctggccgtggagcgctacctgaaggaccagcagctgctgggcatctggggctgcagcggcaagcttatctgcaccaccgccgtgccctggaacgccagctggagcaacaagagcctggagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 7 - DNA, 6787 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcaccatcctgaagtgcaacaacaagaccttcaacggcaccggcccctgcaccaacgtgagcaccgtgcagtgcacccacggcatccgccccgtggtgagcacccagctgctgctgaacggcagcctggccgaggaggaggtggtgatccgcagcgtgaacttcaccgacaacgccaagaccatcatcgtgcagctgaacaccagcgtggagatcaactgcacccgccccaacaacaacacccgcaagcgaattcgcatccagcgcggccccggccgcgccttcgtgaccatcggcaagatcggcaacatgcgccaggcccactgcaacatcagccgcgccaagtggaacaacaccctgaagcagatcgacagcaagctgcgcgagcagttcggcaacaacaagaccatcatcttcaagcagagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgcctgggcggcggcgacatgcgcgacaactggcgcagcgagctgtacaagtacaaggtggtgaagatcgagcccctgggcgtggcccccaccaaggccaagcttaccgtgcaggcccgccagctgctgagcggcatcgtgcagcagcagaacaacctgctgcgcgccatcgaggcccagcagcacctgctgcagctgaccgtgtggggcatcaagcagctgcaggcccgcatcctggccgtggagcgctacctgaaggaccagcagctggagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 8 - DNA, 6607 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcaccatcctgaagtgcaacaacaagaccttcaacggcaccggcccctgcaccaacgtgagcaccgtgcagtgcacccacggcatccgccccgtggtgagcacccagctgctgctgaacggcagcctggccgaggaggaggtggtgatccgcagcgtgaacttcaccgacaacgccaagaccatcatcgtgcagctgaacaccagcgtggagatcaactgcacccgccccaacaacaacacccgcaagcgaattcgcatccagcgcggccccggccgcgccttcgtgaccatcggcaagatcggcaacatgcgccaggcccactgcaacatcagccgcgccaagtggaacaacaccctgaagcagatcgacagcaagctgcgcgagcagttcggcaacaacaagaccatcatcttcaagcagagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgcctgggcggcggcgacatgcgcgacaactggcgcagcgagctgtacaagtacaaggtggtgaagatcgagcccctgggcgtggcccccaccaaggccaagcttaccgtgcaggcccgccagctgctgagcggcatcgtgcagcagcagaacaacctgctgcgcgccatcgaggcccagcagcacctgctgcagctgaccgtgtggggcatcaagcagctgcaggcccgcatcctggccgtggagcgctacctgaaggaccagcagctcgagtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 9 - DNA, 7042 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcaccatcctgaagtgcaacaacaagaccttcaacggcaccggcccctgcaccaacgtgagcaccgtgcagtgcacccacggcatccgccccgtggtgagcacccagctgctgctgaacggcagcctggccgaggaggaggtggtgatccgcagcgtgaacttcaccgacaacgccaagaccatcatcgtgcagctgaacaccagcgtggagatcaactgcacccgccccaacaacaacacccgcaagcgaattcgcatccagcgcggccccggccgcgccttcgtgaccatcggcaagatcggcaacatgcgccaggcccactgcaacatcagccgcgccaagtggaacaacaccctgaagcagatcgacagcaagctgcgcgagcagttcggcaacaacaagaccatcatcttcaagcagagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgcctgggcggcggcgacatgcgcgacaactggcgcagcgagctgtacaagtacaaggtggtgaagatcgagcccctgggcgtggcccccaccaaggccaagcgccgcgtggtgcagcgcgagaagcgcgccgtgggcatcggcgccctgttcctgggcttcctgggcgccgccggcagcaccatgggcgccgccagcatgaccctgaccgtgcaggcccgccagctgctgagcggcatcgtgcagcagcagaacaacctgctgcgcgccatcgaggcccagcagcacctgctgcagctgaccgtgtggggcatcaagcagctgcaggcccgcatcctggccgtggagcgctacctgaaggaccagcagctgctgggcatctggggctgcagcggcaagcttatctgcaccaccgccgtgccctggaacgccagctggagcaacaagagcctggagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 10 - DNA, 6859 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcaccatcctgaagtgcaacaacaagaccttcaacggcaccggcccctgcaccaacgtgagcaccgtgcagtgcacccacggcatccgccccgtggtgagcacccagctgctgctgaacggcagcctggccgaggaggaggtggtgatccgcagcgtgaacttcaccgacaacgccaagaccatcatcgtgcagctgaacaccagcgtggagatcaactgcacccgccccaacaacaacacccgcaagcgaattcgcatccagcgcggccccggccgcgccttcgtgaccatcggcaagatcggcaacatgcgccaggcccactgcaacatcagccgcgccaagtggaacaacaccctgaagcagatcgacagcaagctgcgcgagcagttcggcaacaacaagaccatcatcttcaagcagagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgcctgggcggcggcgacatgcgcgacaactggcgcagcgagctgtacaagtacaaggtggtgaagatcgagcccctgggcgtggcccccaccaaggccaagcttaccgtgcaggcccgccagctgctgagcggcatcgtgcagcagcagaacaacctgctgcgcgccatcgaggcccagcagcacctgctgcagctgaccgtgtggggcatcaagcagctgcaggcccgcatcctggccgtggagcgctacctgaaggaccagcagctggagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 11 - DNA, 6965 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcaccatcctgaagtgcaaggacaagaagttcaacggcaagggcccctgcaccaacgtgagcaccgtgcagtgcacccacggcatccgccccgtggtgagcacccagctgctgctgaacgaccgcctggccgaggaggaggtggtgatccgcagcgccaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgcctgggcggcggcgacatgcgcgacaactggcgcagcgagctgtacaagtacaaggtggtgaagatcgagcccctgggcgtggcccccaccaaggccaagcgccgcgtggtgcagcgcgagaagcgcgccgtgggcatcggcgccctgttcctgggcttcctgggcgccgccggcagcaccatgggcgccgccagcatgaccctgaccgtgcaggcccgccagctgctgagcggcatcgtgcagcagcagaacaacctgctgcgcgccatcgaggcccagcagcacctgctgcagctgaccgtgtggggcatcaagcagctgcaggcccgcatcctggccgtggagcgctacctgaaggaccagcagctgctgggcatctggggctgcagcggcaagcttatctgcaccaccgccgtgccctggaacgccagctggagcaacaagagcctggagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 12 - DNA, 6784 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctggttacgggtaacctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgcctgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagctgctcgagcagatctggaaccacaccacctggatggagtgggaccgcgagatcaacaactacaccagcctgatccacagcctgatcgaggagagccagaaccagcacgagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 13 - DNA, 7037 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcaccatcctgaagtgcaaggacaagaagttcaacggcaagggcccctgcaccaacgtgagcaccgtgcagtgcacccacggcatccgccccgtggtgagcacccagctgctgctgaacgaccgcctggccgaggaggaggtggtgatccgcagcgccaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgcctgggcggcggcgacatgcgcgacaactggcgcagcgagctgtacaagtacaaggtggtgaagatcgagcccctgggcgtggcccccaccaaggccaagcgccgcgtggtgcagcgcgagaagcgcgccgtgggcatcggcgccctgttcctgggcttcctgggcgccgccggcagcaccatgggcgccgccagcatgaccctgaccgtgcaggcccgccagctgctgagcggcatcgtgcagcagcagaacaacctgctgcgcgccatcgaggcccagcagcacctgctgcagctgaccgtgtggggcatcaagcagctgcaggcccgcatcctggccgtggagcgctacctgaaggaccagcagctgctgggcatctggggctgcagcggcaagcttatctgcaccaccgccgtgccctggaacgccagctggagcaacaagagcctggagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 14 - DNA, 6856 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctggttacgggtaacctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgcctgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagctgctcgagcagatctggaaccacaccacctggatggagtgggaccgcgagatcaacaactacaccagcctgatccacagcctgatcgaggagagccagaaccagcacgagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 15 - DNA, 6505 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatgctgatgatctgcagcgccaccgaggctagcagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 16 - DNA, 6505 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccgctagcatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 17 - DNA, 6646 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctggctagcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 18 - DNA, 6670 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcgctagcagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 19 - DNA, 6709 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgctagcgccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 20 - DNA, 6736 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacgctagcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 21 - DNA, 6697 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcgctagcaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 22 - DNA, 6712 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgcgctagcgcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 23 - DNA, 6715 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcgctagcctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 24 - DNA, 6619 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacgctagcaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 25 - DNA, 6655 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacgctagcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgcgctagcgcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 26 - DNA, 6658 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacgctagcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcgctagcctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 27 - DNA, 6616 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcgctagcaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgcgctagcgcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 28 - DNA, 6619 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcgctagcaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcgctagcctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 29 - DNA, 6634 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgcgctagcgcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcgctagcctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 30 - DNA, 6538 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacgctagcaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgcgctagcgcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 31 - DNA, 6541 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacgctagcaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcgctagcctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 32 - DNA, 6577 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacgctagcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgcgctagcgcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcgctagcctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 33 - DNA, 6538 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcgctagcaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgcgctagcgcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcgctagcctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 34 - DNA, 6460 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacgctagcaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgcgctagcgcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcgctagcctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 35 - DNA, 7987 bp, Artificial Sequence
  plasmid pAdApt containing HIV genes
ttaattaaccgcaattctcatgtttgacagcttatcatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagtacgtaccagtgcactggcctagagcggccccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacgctagcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccagggccgcataacttcgtataatgtatgctatacgaagttataagatctgtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattgtt

SEQ ID NO: 36 - DNA, 7948 bp, Artificial Sequence
  plasmid pAdApt containing HIV genes
ttaattaaccgcaattctcatgtttgacagcttatcatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagtacgtaccagtgcactggcctagagcggccccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcgctagcaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccagggccgcataacttcgtataatgtatgctatacgaagttataagatctgtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattgtt

SEQ ID NO: 37 - DNA, 7963 bp, Artificial Sequence
  plasmid pAdApt containing HIV genes
ttaattaaccgcaattctcatgtttgacagcttatcatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagtacgtaccagtgcactggcctagagcggccccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgcgctagcgcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccagggccgcataacttcgtataatgtatgctatacgaagttataagatctgtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattgtt

SEQ ID NO: 38 - DNA, 7966 bp, Artificial Sequence
  plasmid pAdApt containing HIV genes
ttaattaaccgcaattctcatgtttgacagcttatcatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagtacgtaccagtgcactggcctagagcggccccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcgctagcctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccagggccgcataacttcgtataatgtatgctatacgaagttataagatctgtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattgtt

SEQ ID NO: 39 - DNA, 7870 bp, Artificial Sequence
  plasmid pAdApt containing HIV genes
ttaattaaccgcaattctcatgtttgacagcttatcatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagtacgtaccagtgcactggcctagagcggccccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacgctagcaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccagggccgcataacttcgtataatgtatgctatacgaagttataagatctgtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattgtt

SEQ ID NO: 40 - DNA, 7906 bp, Artificial Sequence
  plasmid pAdApt containing HIV genes
ttaattaaccgcaattctcatgtttgacagcttatcatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagtacgtaccagtgcactggcctagagcggccccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacgctagcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgcgctagcgcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccagggccgcataacttcgtataatgtatgctatacgaagttataagatctgtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattgtt

SEQ ID NO: 41 - DNA, 7909 bp, Artificial Sequence
  plasmid pAdApt containing HIV genes
ttaattaaccgcaattctcatgtttgacagcttatcatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagtacgtaccagtgcactggcctagagcggccccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacgctagcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcgctagcctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccagggccgcataacttcgtataatgtatgctatacgaagttataagatctgtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattgtt

SEQ ID NO: 42 - DNA, 7867 bp, Artificial Sequence
  plasmid pAdApt containing HIV genes
ttaattaaccgcaattctcatgtttgacagcttatcatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagtacgtaccagtgcactggcctagagcggccccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcgctagcaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgcgctagcgcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccagggccgcataacttcgtataatgtatgctatacgaagttataagatctgtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattgtt

SEQ ID NO: 43 - DNA, 7870 bp, Artificial Sequence
  plasmid pAdApt containing HIV genes
ttaattaaccgcaattctcatgtttgacagcttatcatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagtacgtaccagtgcactggcctagagcggccccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcgctagcaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcgctagcctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccagggccgcataacttcgtataatgtatgctatacgaagttataagatctgtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattgtt

SEQ ID NO: 44 - DNA, 7885 bp, Artificial Sequence
  plasmid pAdApt containing HIV genes
ttaattaaccgcaattctcatgtttgacagcttatcatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagtacgtaccagtgcactggcctagagcggccccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgcgctagcgcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcgctagcctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccagggccgcataacttcgtataatgtatgctatacgaagttataagatctgtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattgtt

SEQ ID NO: 45 - DNA, 7789 bp, Artificial Sequence
  plasmid pAdApt containing HIV genes
ttaattaaccgcaattctcatgtttgacagcttatcatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagtacgtaccagtgcactggcctagagcggccccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacgctagcaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgcgctagcgcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccagggccgcataacttcgtataatgtatgctatacgaagttataagatctgtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattgtt

SEQ ID NO: 46 - DNA, 7792 bp, Artificial Sequence
  plasmid pAdApt containing HIV genes
ttaattaaccgcaattctcatgtttgacagcttatcatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagtacgtaccagtgcactggcctagagcggccccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacgctagcaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcgctagcctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccagggccgcataacttcgtataatgtatgctatacgaagttataagatctgtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattgtt

SEQ ID NO: 47 - DNA, 7828 bp, Artificial Sequence
  plasmid pAdApt containing HIV genes
ttaattaaccgcaattctcatgtttgacagcttatcatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagtacgtaccagtgcactggcctagagcggccccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacgctagcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgcgctagcgcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcgctagcctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccagggccgcataacttcgtataatgtatgctatacgaagttataagatctgtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattgtt

SEQ ID NO: 48 - DNA, 7789 bp, Artificial Sequence
  plasmid pAdApt containing HIV genes
ttaattaaccgcaattctcatgtttgacagcttatcatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagtacgtaccagtgcactggcctagagcggccccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcgctagcaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgcgctagcgcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcgctagcctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccagggccgcataacttcgtataatgtatgctatacgaagttataagatctgtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattgtt

SEQ ID NO: 49 - DNA, 7711 bp, Artificial Sequence
  plasmid pAdApt containing HIV genes
ttaattaaccgcaattctcatgtttgacagcttatcatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagtacgtaccagtgcactggcctagagcggccccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacgctagcaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgcgctagcgcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcgctagcctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccagggccgcataacttcgtataatgtatgctatacgaagttataagatctgtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattgtt

SEQ ID NO: 50 - DNA, 6577 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatgctgatgatctgcagcgccaccgaggctagcagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcacgagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 51 - DNA, 6577 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccgctagcatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcacgagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 52 - DNA, 6718 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctggctagcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcacgagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 53 - DNA, 6742 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcgctagcagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcacgagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 54 - DNA, 6781 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgctagcgccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcacgagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 55 - DNA, 6808 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacgctagcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 56 - DNA, 6769 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcgctagcaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 57 - DNA, 6784 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgcgctagcgcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 58 - DNA, 6787 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcgctagcctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 59 - DNA, 6691 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacgctagcaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 60 - DNA, 6727 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacgctagcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgcgctagcgcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 61 - DNA, 6730 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacgctagcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcgctagcctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 62 - DNA, 6688 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcgctagcaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgcgctagcgcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 63 - DNA, 6691 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcgctagcaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcgctagcctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 64 - DNA, 6706 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgcgctagcgcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcgctagcctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 65 - DNA, 6649 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacgctagcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgcgctagcgcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcgctagcctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 66 - DNA, 6610 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcgctagcaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgcgctagcgcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcgctagcctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 67 - DNA, 6610 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacgctagcaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgcgctagcgcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 68 - DNA, 6613 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacgctagcaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcgctagcctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 69 - DNA, 6532 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacgctagcaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgcgctagcgcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcgctagcctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgtccgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 70 - DNA, 7181 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcaccatcctgaagtgcaaggacaagaagttcaacggcaagggcccctgcaccaacgtgagcaccgtgcagtgcacccacggcatccgccccgtggtgagcacccagctgctgctgaacgaccgcctggccgaggaggaggtggtgatccgcagcgccaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgcctgggcggcggcgacatgcgcgacaactggcgcagcgagctgtacaagtacaaggtggtgaagatcgagcccctgggcgtggcccccaccaaggccaagcgccgcgtggtgcagcgcgagaagcgcgccgtgggcatcggcgccctgttcctgggcttcctgggcgccgccggcagcaccatgggcgccgccagcatgaccctgaccgtgcaggcccgccagctgctgagcggcatcgtgcagcagcagaacaacctgctgcgcgccatcgaggcccagcagcacctgctgcagctgaccgtgtggggcatcaagcagctgcaggcccgcatcctggccgtggagcgctacctgaaggaccagcagctgctgggcatctggggctgcagcggcaagcttatctgcaccaccgccgtgccctggaacgccagctggagcaacaagagcctggagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatcgtgaaccgcgtgcgccagggctacagccccctgagcttccagacccacctgcccatcccccgcggccccgaccgccccgagggcatcgaggaggagggcggcgagcgcgaccgcgaccgcacgatccgcctggtgaacggcagctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 71 - DNA, 7493 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcaccatcctgaagtgcaaggacaagaagttcaacggcaagggcccctgcaccaacgtgagcaccgtgcagtgcacccacggcatccgccccgtggtgagcacccagctgctgctgaacgaccgcctggccgaggaggaggtggtgatccgcagcgccaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgcctgggcggcggcgacatgcgcgacaactggcgcagcgagctgtacaagtacaaggtggtgaagatcgagcccctgggcgtggcccccaccaaggccaagcgccgcgtggtgcagcgcgagaagcgcgccgtgggcatcggcgccctgttcctgggcttcctgggcgccgccggcagcaccatgggcgccgccagcatgaccctgaccgtgcaggcccgccagctgctgagcggcatcgtgcagcagcagaacaacctgctgcgcgccatcgaggcccagcagcacctgctgcagctgaccgtgtggggcatcaagcagctgcaggcccgcatcctggccgtggagcgctacctgaaggaccagcagctgctgggcatctggggctgcagcggcaagcttatctgcaccaccgccgtgccctggaacgccagctggagcaacaagagcctggagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatcgtgaaccgcgtgcgccagggctacagccccctgagcttccagacccacctgcccatcccccgcggccccgaccgccccgagggcatcgaggaggagggcggcgagcgcgaccgcgaccgcacgatccgcctggtgaacggcagcctggccctgatctgggacgacctgcgcagcctgtgcctgttcagctaccaccgcctgcgcgacctgctgctgatcgtgacccgcatcgtggagctgctgggccgccgcggctgggaggccctgaagtactggtggaacctgctgcagtactggagccaggagctgaagaacagcgccgtgagcctgctgaacgccaccgccatcgccgtggccgagggcaccgaccgcgtgatcgaggtggtgcagggcgcctgccgcgccatccgccacatcccccgccgcatccgccagggcctggagcgcatcctgctgtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 72 - DNA, 7186 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcaccatcctgaagtgcaacaacaagaccttcaacggcaccggcccctgcaccaacgtgagcaccgtgcagtgcacccacggcatccgccccgtggtgagcacccagctgctgctgaacggcagcctggccgaggaggaggtggtgatccgcagcgtgaacttcaccgacaacgccaagaccatcatcgtgcagctgaacaccagcgtggagatcaactgcacccgccccaacaacaacacccgcaagcgaattcgcatccagcgcggccccggccgcgccttcgtgaccatcggcaagatcggcaacatgcgccaggcccactgcaacatcagccgcgccaagtggaacaacaccctgaagcagatcgacagcaagctgcgcgagcagttcggcaacaacaagaccatcatcttcaagcagagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgcctgggcggcggcgacatgcgcgacaactggcgcagcgagctgtacaagtacaaggtggtgaagatcgagcccctgggcgtggcccccaccaaggccaagcgccgcgtggtgcagcgcgagaagcgcgccgtgggcatcggcgccctgttcctgggcttcctgggcgccgccggcagcaccatgggcgccgccagcatgaccctgaccgtgcaggcccgccagctgctgagcggcatcgtgcagcagcagaacaacctgctgcgcgccatcgaggcccagcagcacctgctgcagctgaccgtgtggggcatcaagcagctgcaggcccgcatcctggccgtggagcgctacctgaaggaccagcagctgctgggcatctggggctgcagcggcaagcttatctgcaccaccgccgtgccctggaacgccagctggagcaacaagagcctggagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatcgtgaaccgcgtgcgccagggctacagccccctgagcttccagacccacctgcccatcccccgcggccccgaccgccccgagggcatcgaggaggagggcggcgagcgcgaccgcgaccgcacgatccgcctggtgaacggcagctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 73 - DNA, 7003 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcaccatcctgaagtgcaacaacaagaccttcaacggcaccggcccctgcaccaacgtgagcaccgtgcagtgcacccacggcatccgccccgtggtgagcacccagctgctgctgaacggcagcctggccgaggaggaggtggtgatccgcagcgtgaacttcaccgacaacgccaagaccatcatcgtgcagctgaacaccagcgtggagatcaactgcacccgccccaacaacaacacccgcaagcgaattcgcatccagcgcggccccggccgcgccttcgtgaccatcggcaagatcggcaacatgcgccaggcccactgcaacatcagccgcgccaagtggaacaacaccctgaagcagatcgacagcaagctgcgcgagcagttcggcaacaacaagaccatcatcttcaagcagagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgcctgggcggcggcgacatgcgcgacaactggcgcagcgagctgtacaagtacaaggtggtgaagatcgagcccctgggcgtggcccccaccaaggccaagcttaccgtgcaggcccgccagctgctgagcggcatcgtgcagcagcagaacaacctgctgcgcgccatcgaggcccagcagcacctgctgcagctgaccgtgtggggcatcaagcagctgcaggcccgcatcctggccgtggagcgctacctgaaggaccagcagctggagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatcgtgaaccgcgtgcgccagggctacagccccctgagcttccagacccacctgcccatcccccgcggccccgaccgccccgagggcatcgaggaggagggcggcgagcgcgaccgcgaccgcacgatccgcctggtgaacggcagctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 74 - DNA, 7186 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtcgacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaaggactgtagcttcgacatcagcaccagcatccgcggcaaggtgcagaaggagtacgccttcttctacaagctggacatcatccccatcgacaacgacaccaccagctacagcctgaccagctgcgaaactagtgtgatcacccaggcctgccccaaggtgagcttcgagcccatccccaaccactactgcgcccccgccggcttcaccatcctgaagtgcaacgacaagaccttcgacggcaccgggccctgcaccgacgtgagcaccgtgcagtgcacccacggcatccgccccgtggtgagcacccagctgctgctgaacggcagcctggccgaggaggaggtggtgatccgcagcgtcgacttcaccgacaacgccaagaccatcatcgtgcaggtggacaccacggtggagatcgattgcacccgccccaacaacaacacccgcaagcgaattcgcatccagcgcggccccggccgcgccttcgtgaccatcggcaagatcggcaacatgcgccaggcccactgcgatatcagccgcgccaagtgggacaacaccctgaagcagatcgacagcaagctgcgcgagcagttcggcaacgacaagaccatcatcttcaagcagagcagcggcggcgaccccgagatcgtgacccacagcttcaactgcggcggcgagttcttctactgcgacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcgatatcaccggcctgctgctgacccgcgacggcggcaacagcaacaacgagagcgagatcttccgcctgggcggcggcgacatgcgcgacaactggcgcagcgagctgtacaagtacaaggtggtgaagatcgagcccctgggcgtggcccccaccaaggccaagcgccgcgtggtgcagcgcgagaagcgcgccgtgggcatcggcgccctgttcctgggcttcctgggcgccgccggcagcaccatgggcgccgccagcatgaccctgaccgtgcaggcccgccagctgctgagcggcatcgtgcagcagcagaacaacctgctgcgcgccatcgaggcccagcagcacctgctgcagctgaccgtgtggggcatcaagcagctgcaggcccgcatcctggccgtggagcgctacctgaaggaccagcagctgctgggcatctggggctgcagcggcaagcttatctgcaccaccgccgtgccctggaacgccagctggagcaacaagagcctggagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatcgtgaaccgcgtgcgccagggctacagccccctgagcttccagacccacctgcccatcccccgcggccccgaccgccccgagggcatcgaggaggagggcggcgagcgcgaccgcgaccgcacgatccgcctggtgaacggcagctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 75 - DNA, 7186 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtcgacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaaggactgtagcttcgacatcagcaccagcatccgcggcaaggtgcagaaggagtacgccttcttctacaagctggacatcatccccatcgacaacgacaccaccagctacagcctgaccagctgcgaaactagtgtgatcacccaggcctgccccaaggtgagcttcgagcccatccccaaccactactgcgcccccgccggcttcaccatcctgaagtgcaacgacaagaccttcgacggcaccgggccctgcaccgacgtgagcaccgtgcagtgcacccacggcatccgccccgtggtgagcacccagctgctgctgaacggcagcctggccgaggaggaggtggtgatccgcagcgtcgacttcaccgacaacgccaagaccatcatcgtgcaggtggacaccacggtggagatcgattgcacccgccccaacaacaacacccgcaagcgaattcgcatccagcgcggccccggccgcgccttcgtgaccatcggcaagatcggcaacatgcgccaggcccactgcaacatcagccgcgccaagtggaacaacaccctgaagcagatcgacagcaagctgcgcgagcagttcggcaacaacaagaccatcatcttcaagcagagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgcctgggcggcggcgacatgcgcgacaactggcgcagcgagctgtacaagtacaaggtggtgaagatcgagcccctgggcgtggcccccaccaaggccaagcgccgcgtggtgcagcgcgagaagcgcgccgtgggcatcggcgccctgttcctgggcttcctgggcgccgccggcagcaccatgggcgccgccagcatgaccctgaccgtgcaggcccgccagctgctgagcggcatcgtgcagcagcagaacaacctgctgcgcgccatcgaggcccagcagcacctgctgcagctgaccgtgtggggcatcaagcagctgcaggcccgcatcctggccgtggagcgctacctgaaggaccagcagctgctgggcatctggggctgcagcggcaagcttatctgcaccaccgccgtgccctggaacgccagctggagcaacaagagcctggagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatcgtgaaccgcgtgcgccagggctacagccccctgagcttccagacccacctgcccatcccccgcggccccgaccgccccgagggcatcgaggaggagggcggcgagcgcgaccgcgaccgcacgatccgcctggtgaacggcagctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 76 - DNA, 7498 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcaccatcctgaagtgcaacaacaagaccttcaacggcaccggcccctgcaccaacgtgagcaccgtgcagtgcacccacggcatccgccccgtggtgagcacccagctgctgctgaacggcagcctggccgaggaggaggtggtgatccgcagcgtgaacttcaccgacaacgccaagaccatcatcgtgcagctgaacaccagcgtggagatcaactgcacccgccccaacaacaacacccgcaagcgaattcgcatccagcgcggccccggccgcgccttcgtgaccatcggcaagatcggcaacatgcgccaggcccactgcaacatcagccgcgccaagtggaacaacaccctgaagcagatcgacagcaagctgcgcgagcagttcggcaacaacaagaccatcatcttcaagcagagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgcctgggcggcggcgacatgcgcgacaactggcgcagcgagctgtacaagtacaaggtggtgaagatcgagcccctgggcgtggcccccaccaaggccaagcgccgcgtggtgcagcgcgagaagcgcgccgtgggcatcggcgccctgttcctgggcttcctgggcgccgccggcagcaccatgggcgccgccagcatgaccctgaccgtgcaggcccgccagctgctgagcggcatcgtgcagcagcagaacaacctgctgcgcgccatcgaggcccagcagcacctgctgcagctgaccgtgtggggcatcaagcagctgcaggcccgcatcctggccgtggagcgctacctgaaggaccagcagctgctgggcatctggggctgcagcggcaagcttatctgcaccaccgccgtgccctggaacgccagctggagcaacaagagcctggagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatcgtgaaccgcgtgcgccagggctacagccccctgagcttccagacccacctgcccatcccccgcggccccgaccgccccgagggcatcgaggaggagggcggcgagcgcgaccgcgaccgcacgatccgcctggtgaacggcagcctggccctgatctgggacgacctgcgcagcctgtgcctgttcagctaccaccgcctgcgcgacctgctgctgatcgtgacccgcatcgtggagctgctgggccgccgcggctgggaggccctgaagtactggtggaacctgctgcagtactggagccaggagctgaagaacagcgccgtgagcctgctgaacgccaccgccatcgccgtggccgagggcaccgaccgcgtgatcgaggtggtgcagggcgcctgccgcgccatccgccacatcccccgccgcatccgccagggcctggagcgcatcctgctgtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 77 - DNA, 7315 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcaccatcctgaagtgcaacaacaagaccttcaacggcaccggcccctgcaccaacgtgagcaccgtgcagtgcacccacggcatccgccccgtggtgagcacccagctgctgctgaacggcagcctggccgaggaggaggtggtgatccgcagcgtgaacttcaccgacaacgccaagaccatcatcgtgcagctgaacaccagcgtggagatcaactgcacccgccccaacaacaacacccgcaagcgaattcgcatccagcgcggccccggccgcgccttcgtgaccatcggcaagatcggcaacatgcgccaggcccactgcaacatcagccgcgccaagtggaacaacaccctgaagcagatcgacagcaagctgcgcgagcagttcggcaacaacaagaccatcatcttcaagcagagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgcctgggcggcggcgacatgcgcgacaactggcgcagcgagctgtacaagtacaaggtggtgaagatcgagcccctgggcgtggcccccaccaaggccaagcttaccgtgcaggcccgccagctgctgagcggcatcgtgcagcagcagaacaacctgctgcgcgccatcgaggcccagcagcacctgctgcagctgaccgtgtggggcatcaagcagctgcaggcccgcatcctggccgtggagcgctacctgaaggaccagcagctggagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatcgtgaaccgcgtgcgccagggctacagccccctgagcttccagacccacctgcccatcccccgcggccccgaccgccccgagggcatcgaggaggagggcggcgagcgcgaccgcgaccgcacgatccgcctggtgaacggcagcctggccctgatctgggacgacctgcgcagcctgtgcctgttcagctaccaccgcctgcgcgacctgctgctgatcgtgacccgcatcgtggagctgctgggccgccgcggctgggaggccctgaagtactggtggaacctgctgcagtactggagccaggagctgaagaacagcgccgtgagcctgctgaacgccaccgccatcgccgtggccgagggcaccgaccgcgtgatcgaggtggtgcagggcgcctgccgcgccatccgccacatcccccgccgcatccgccagggcctggagcgcatcctgctgtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 78 - DNA, 7498 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtcgacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaaggactgtagcttcgacatcagcaccagcatccgcggcaaggtgcagaaggagtacgccttcttctacaagctggacatcatccccatcgacaacgacaccaccagctacagcctgaccagctgcgaaactagtgtgatcacccaggcctgccccaaggtgagcttcgagcccatccccaaccactactgcgcccccgccggcttcaccatcctgaagtgcaacgacaagaccttcgacggcaccgggccctgcaccgacgtgagcaccgtgcagtgcacccacggcatccgccccgtggtgagcacccagctgctgctgaacggcagcctggccgaggaggaggtggtgatccgcagcgtcgacttcaccgacaacgccaagaccatcatcgtgcaggtggacaccacggtggagatcgattgcacccgccccaacaacaacacccgcaagcgaattcgcatccagcgcggccccggccgcgccttcgtgaccatcggcaagatcggcaacatgcgccaggcccactgcgatatcagccgcgccaagtgggacaacaccctgaagcagatcgacagcaagctgcgcgagcagttcggcaacgacaagaccatcatcttcaagcagagcagcggcggcgaccccgagatcgtgacccacagcttcaactgcggcggcgagttcttctactgcgacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcgatatcaccggcctgctgctgacccgcgacggcggcaacagcaacaacgagagcgagatcttccgcctgggcggcggcgacatgcgcgacaactggcgcagcgagctgtacaagtacaaggtggtgaagatcgagcccctgggcgtggcccccaccaaggccaagcgccgcgtggtgcagcgcgagaagcgcgccgtgggcatcggcgccctgttcctgggcttcctgggcgccgccggcagcaccatgggcgccgccagcatgaccctgaccgtgcaggcccgccagctgctgagcggcatcgtgcagcagcagaacaacctgctgcgcgccatcgaggcccagcagcacctgctgcagctgaccgtgtggggcatcaagcagctgcaggcccgcatcctggccgtggagcgctacctgaaggaccagcagctgctgggcatctggggctgcagcggcaagcttatctgcaccaccgccgtgccctggaacgccagctggagcaacaagagcctggagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatcgtgaaccgcgtgcgccagggctacagccccctgagcttccagacccacctgcccatcccccgcggccccgaccgccccgagggcatcgaggaggagggcggcgagcgcgaccgcgaccgcacgatccgcctggtgaacggcagcctggccctgatctgggacgacctgcgcagcctgtgcctgttcagctaccaccgcctgcgcgacctgctgctgatcgtgacccgcatcgtggagctgctgggccgccgcggctgggaggccctgaagtactggtggaacctgctgcagtactggagccaggagctgaagaacagcgccgtgagcctgctgaacgccaccgccatcgccgtggccgagggcaccgaccgcgtgatcgaggtggtgcagggcgcctgccgcgccatccgccacatcccccgccgcatccgccagggcctggagcgcatcctgctgtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 79 - DNA, 7498 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtcgacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaaggactgtagcttcgacatcagcaccagcatccgcggcaaggtgcagaaggagtacgccttcttctacaagctggacatcatccccatcgacaacgacaccaccagctacagcctgaccagctgcgaaactagtgtgatcacccaggcctgccccaaggtgagcttcgagcccatccccaaccactactgcgcccccgccggcttcaccatcctgaagtgcaacgacaagaccttcgacggcaccgggccctgcaccgacgtgagcaccgtgcagtgcacccacggcatccgccccgtggtgagcacccagctgctgctgaacggcagcctggccgaggaggaggtggtgatccgcagcgtcgacttcaccgacaacgccaagaccatcatcgtgcaggtggacaccacggtggagatcgattgcacccgccccaacaacaacacccgcaagcgaattcgcatccagcgcggccccggccgcgccttcgtgaccatcggcaagatcggcaacatgcgccaggcccactgcaacatcagccgcgccaagtggaacaacaccctgaagcagatcgacagcaagctgcgcgagcagttcggcaacaacaagaccatcatcttcaagcagagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgcctgggcggcggcgacatgcgcgacaactggcgcagcgagctgtacaagtacaaggtggtgaagatcgagcccctgggcgtggcccccaccaaggccaagcgccgcgtggtgcagcgcgagaagcgcgccgtgggcatcggcgccctgttcctgggcttcctgggcgccgccggcagcaccatgggcgccgccagcatgaccctgaccgtgcaggcccgccagctgctgagcggcatcgtgcagcagcagaacaacctgctgcgcgccatcgaggcccagcagcacctgctgcagctgaccgtgtggggcatcaagcagctgcaggcccgcatcctggccgtggagcgctacctgaaggaccagcagctgctgggcatctggggctgcagcggcaagcttatctgcaccaccgccgtgccctggaacgccagctggagcaacaagagcctggagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatcgtgaaccgcgtgcgccagggctacagccccctgagcttccagacccacctgcccatcccccgcggccccgaccgccccgagggcatcgaggaggagggcggcgagcgcgaccgcgaccgcacgatccgcctggtgaacggcagcctggccctgatctgggacgacctgcgcagcctgtgcctgttcagctaccaccgcctgcgcgacctgctgctgatcgtgacccgcatcgtggagctgctgggccgccgcggctgggaggccctgaagtactggtggaacctgctgcagtactggagccaggagctgaagaacagcgccgtgagcctgctgaacgccaccgccatcgccgtggccgagggcaccgaccgcgtgatcgaggtggtgcagggcgcctgccgcgccatccgccacatcccccgccgcatccgccagggcctggagcgcatcctgctgtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 80 - DNA, 5549 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaccaccatgggcggcaagtggagcaagagcagcgtgatcggctggcccgccgtgcgcgagcgcatgcgccgcgccgagcccgccgccgacggcgtgggcgccgtgagccgcgacctggagaagcacggcgccatcaccagcagcaacaccgccgccaacaacgccgcctgcgcctggctggaggcccaggaggaggaggaggtgggcttccccgtgaccccccaggtgcccctgcgccccatgacctacaaggccgccgtggacctgagccacttcctgaaggagaagggcggcctggagggcctgatccacagccagcgccgccaggacatcctggacctgtggatctaccacacccagggctacttccccgactggcagaactacacccccggccccggcgtgcgctaccccctgaccttcggctggtgctacaagctggtgcccgtggagcccgacaaggtggaggaggccaacaagggcgagaacaccagcctgctgcaccccgtgagcctgcacggcatggacgaccccgagcgcgaggtgctggagtggcgcttcgacagccgcctggccttccaccacgtggcccgcgagctgcaccccgagtacttcaagaactgctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 81 - DNA, 5549 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaccaccatgggcggcaagtggagcaagagcagcgtgatcggctggcccgccgtgcgcgagcgcatgcgccgcgccgagcccgccgccgacggcgtgggcgccgtgagccgcgacctggagaagcacggcgccatcaccagcagcaacaccgccgccaacaacgccgcctgcgcctggctggaggcccaggaggaggaggaggtgggcttcgcagtgaccgcacaggtggcactgcgcgcaatgacctacaaggccgccgtggacctgagccacttcctgaaggagaagggcggcctggagggcctgatccacagccagcgccgccaggacatcctggacctgtggatctaccacacccagggctacttccccgactggcagaactacacccccggccccggcgtgcgctaccccctgaccttcggctggtgctacaagctggtgcccgtggagcccgacaaggtggaggaggccaacaagggcgagaacaccagcctgctgcaccccgtgagcctgcacggcatggcagcacccgagcgcgaggtgctggagtggcgcttcgacagccgcctggccttccaccacgtggcccgcgagctgcaccccgagtacttcaagaactgctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 82 - DNA, 5549 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaccaccatgggcggcaagtggagcaagagcagcgtgatcggctggcccgccgtgcgcgagcgcatgcgccgcgccgagcccgccgccgacggcgtgggcgccgtgagccgcgacctggagaagcacggcgccatcaccagcagcaacaccgccgccaacaacgccgcctgcgcctggctggaggcccaggaggaggaggaggtgggcttccccgtgaccccccaggtgcccctgcgccccatgacctacaaggccgccgtggacctgagccacttcctgaaggagaagggcggcctggagggcctgatccacagccagcgccgccaggacatcctggacctgtggatctaccacacccagggctacttccccgactggcagaactacacccccggccccggcgtgcgctaccccctgaccttcggctggtgctacaagctggtgcccgtggagcccgacaaggtggaggaggccaacaagggcgagaacaccagcctgctgcaccccgtgagcctgcacggcatggcagcacccgagcgcgaggtgctggagtggcgcttcgacagccgcctggccttccaccacgtggcccgcgagctgcaccccgagtacttcaagaactgctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 83 - DNA, 5549 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaccaccatgggcggcaagtggagcaagagcagcgtgatcggctggcccgccgtgcgcgagcgcatgcgccgcgccgagcccgccgccgacggcgtgggcgccgtgagccgcgacctggagaagcacggcgccatcaccagcagcaacaccgccgccaacaacgccgcctgcgcctggctggaggcccaggaggaggaggaggtgggcttcgcagtgaccgcacaggtggcactgcgcgcaatgacctacaaggccgccgtggacctgagccacttcctgaaggagaagggcggcctggagggcctgatccacagccagcgccgccaggacatcctggacctgtggatctaccacacccagggctacttccccgactggcagaactacacccccggccccggcgtgcgctaccccctgaccttcggctggtgctacaagctggtgcccgtggagcccgacaaggtggaggaggccaacaagggcgagaacaccagcctgctgcaccccgtgagcctgcacggcatggacgaccccgagcgcgaggtgctggagtggcgcttcgacagccgcctggccttccaccacgtggcccgcgagctgcaccccgagtacttcaagaactgctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 84 - DNA, 6609 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggcgcgaggccaccaccaccctgttctgcgccagcgacgccaaggcctacgacaccgaggtgcacaacgtgtgggccacccacgcctgcgtgcccaccgaccccaacccccaggaggtggtgctgggcaacgtgaccgagaacttcaacatgtggaagaacaacatggtggaccagatgcacgaggacatcatcagcctgtgggacgagagcctgaagccctgcgtgaagctgacccccctgtgcgtgaccctgaactgcaccaacctgaacatcaccaagaacaccaccaacctgaccagcagcagctggggcatgatggaggagggcgagatcaagaactgcagcttctacatcaccaccagcatccgcaacaaggtgaagaaggagtacgccctgttcaaccgcctggacgtggtgcccgtgaagaacaccagcaacaccaagtaccgcctgatcagctgcaacaccagcgtgatcacccaggcctgccccaaggtgagcttccagcccatccccatccactactgcgtgcccgccggcttcgccatcctgaagtgcaacaacaagaccttcaacggcagcggcccctgcaccaacgtgagcaccgtgcagtgcacccacggcatccgccccgtggtgagcacccagctgctgctgaacggcagcctggccgaggaggacatcgtgatccgcagcgaggacttcaccgacaacgtgaagaccatcatcgtgcagctgaacgagagcgtggtgatcaactgcacccgccccaacaacaacacccgcgagcgcctgagcatcggccccggccgcgccttctacgcccgccgcaacatcatcggcgacatccgccaggcccactgcaacatcagccgcgccaagtggaacaacaccctgcagcagatcgtgatcaagctgcgcgagaagttccgcaacaagaccatcgccttcaaccagagcagcggcggcgaccccgagatcgtgatgcacagcttcaactgcggcggcgagttcttctactgcaacaccgcccagctgttcaacagcacctggaacgtggccggcggcaccaacggcaccgagggcaacgacatcatcaccctgcagtgccgcatcaagcagatcatcaacatgtggcagaaggtgggcaaggccatgtacgccccccccatcaccggccagatccgctgcagcagcaacatcaccggcctgctgctgacccgcgacggcggcaacagcaccgagaccgagaccgagatcttccgccccggcggcggcgacatgcgcgacaactggcgcagcgagctgtacaagtacaaggtggtgcgcatcgagcccatcggcgtggcccccacccgcgccaagcttaccgtgcaggcccgcctgctgctgagcggcatcgtgcagcagcagaacaacctgctgcgcgccatcgaggcccagcagaacatgctgcgcctgaccgtgtggggcatcaagcagctgcaggcccgcgtgctggccctggagcgctacctgcgcgaccagcagctcgagtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 85 - DNA, 6783 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggcgcgaggccaccaccaccctgttctgcgccagcgacgccaaggcctacgacaccgaggtgcacaacgtgtgggccacccacgcctgcgtgcccaccgaccccaacccccaggaggtggtgctgggcaacgtgaccgagaacttcaacatgtggaagaacaacatggtggaccagatgcacgaggacatcatcagcctgtgggacgagagcctgaagccctgcgtgaagctgacccccctgtgcgtgaccctgaactgcaccaacctgaacatcaccaagaacaccaccaacctgaccagcagcagctggggcatgatggaggagggcgagatcaagaactgcagcttctacatcaccaccagcatccgcaacaaggtgaagaaggagtacgccctgttcaaccgcctggacgtggtgcccgtgaagaacaccagcaacaccaagtaccgcctgatcagctgcaacaccagcgtgatcacccaggcctgccccaaggtgagcttccagcccatccccatccactactgcgtgcccgccggcttcgccatcctgaagtgcaacaacaagaccttcaacggcagcggcccctgcaccaacgtgagcaccgtgcagtgcacccacggcatccgccccgtggtgagcacccagctgctgctgaacggcagcctggccgaggaggacatcgtgatccgcagcgaggacttcaccgacaacgtgaagaccatcatcgtgcagctgaacgagagcgtggtgatcaactgcacccgccccaacaacaacacccgcgagcgcctgagcatcggccccggccgcgccttctacgcccgccgcaacatcatcggcgacatccgccaggcccactgcaacatcagccgcgccaagtggaacaacaccctgcagcagatcgtgatcaagctgcgcgagaagttccgcaacaagaccatcgccttcaaccagagcagcggcggcgaccccgagatcgtgatgcacagcttcaactgcggcggcgagttcttctactgcaacaccgcccagctgttcaacagcacctggaacgtggccggcggcaccaacggcaccgagggcaacgacatcatcaccctgcagtgccgcatcaagcagatcatcaacatgtggcagaaggtgggcaaggccatgtacgccccccccatcaccggccagatccgctgcagcagcaacatcaccggcctgctgctgacccgcgacggcggcaacagcaccgagaccgagaccgagatcttccgccccggcggcggcgacatgcgcgacaactggcgcagcgagctgtacaagtacaaggtggtgcgcatcgagcccatcggcgtggcccccacccgcgccaagcttaccgtgcaggcccgcctgctgctgagcggcatcgtgcagcagcagaacaacctgctgcgcgccatcgaggcccagcagaacatgctgcgcctgaccgtgtggggcatcaagcagctgcaggcccgcgtgctggccctggagcgctacctgcgcgaccagcagctcgaggacatctggaacaacatgacctggatggagtgggagcgcgagatcgacaactacaccgactacatctacgacctgctggagaagagccagacccagcaggagaagaacgagaaggagctgctggagctggacaagtgggccagcctgtggaactggttcgacatcaccaactggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 86 - DNA, 6861 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggcgcgaggccaccaccaccctgttctgcgccagcgacgccaaggcctacgacaccgaggtgcacaacgtgtgggccacccacgcctgcgtgcccaccgaccccaacccccaggaggtggtgctgggcaacgtgaccgagaacttcaacatgtggaagaacaacatggtggaccagatgcacgaggacatcatcagcctgtgggacgagagcctgaagccctgcgtgaagctgacccccctgtgcgtgaccctgaactgcaccaacctgaacatcaccaagaacaccaccaacctgaccagcagcagctggggcatgatggaggagggcgagatcaagaactgcagcttctacatcaccaccagcatccgcaacaaggtgaagaaggagtacgccctgttcaaccgcctggacgtggtgcccgtgaagaacaccagcaacaccaagtaccgcctgatcagctgcaacaccagcgtgatcacccaggcctgccccaaggtgagcttccagcccatccccatccactactgcgtgcccgccggcttcgccatcctgaagtgcaacaacaagaccttcaacggcagcggcccctgcaccaacgtgagcaccgtgcagtgcacccacggcatccgccccgtggtgagcacccagctgctgctgaacggcagcctggccgaggaggacatcgtgatccgcagcgaggacttcaccgacaacgtgaagaccatcatcgtgcagctgaacgagagcgtggtgatcaactgcacccgccccaacaacaacacccgcgagcgcctgagcatcggccccggccgcgccttctacgcccgccgcaacatcatcggcgacatccgccaggcccactgcaacatcagccgcgccaagtggaacaacaccctgcagcagatcgtgatcaagctgcgcgagaagttccgcaacaagaccatcgccttcaaccagagcagcggcggcgaccccgagatcgtgatgcacagcttcaactgcggcggcgagttcttctactgcaacaccgcccagctgttcaacagcacctggaacgtggccggcggcaccaacggcaccgagggcaacgacatcatcaccctgcagtgccgcatcaagcagatcatcaacatgtggcagaaggtgggcaaggccatgtacgccccccccatcaccggccagatccgctgcagcagcaacatcaccggcctgctgctgacccgcgacggcggcaacagcaccgagaccgagaccgagatcttccgccccggcggcggcgacatgcgcgacaactggcgcagcgagctgtacaagtacaaggtggtgcgcatcgagcccatcggcgtggcccccacccgcgccaagcttaccgtgcaggcccgcctgctgctgagcggcatcgtgcagcagcagaacaacctgctgcgcgccatcgaggcccagcagaacatgctgcgcctgaccgtgtggggcatcaagcagctgcaggcccgcgtgctggccctggagcgctacctgcgcgaccagcagctcgaggacatctggaacaacatgacctggatggagtgggagcgcgagatcgacaactacaccgactacatctacgacctgctggagaagagccagacccagcaggagaagaacgagaaggagctgctggagctggacaagtgggccagcctgtggaactggttcgacatcaccaactggctgtggtacatccgcctgttcatcatgatcgtgggcggcctgatcggcctgcgcatcgtgttcgccgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 87 - DNA, 7552 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggcgcgaggccaccaccaccctgttctgcgccagcgacgccaaggcctacgacaccgaggtgcacaacgtgtgggccacccacgcctgcgtgcccaccgaccccaacccccaggaggtggtgctgggcaacgtgaccgagaacttcaacatgtggaagaacaacatggtggaccagatgcacgaggacatcatcagcctgtgggacgagagcctgaagccctgcgtgaagctgacccccctgtgcgtgaccctgaactgcaccaacctgaacatcaccaagaacaccaccaacctgaccagcagcagctggggcatgatggaggagggcgagatcaagaactgcagcttctacatcaccaccagcatccgcaacaaggtgaagaaggagtacgccctgttcaaccgcctggacgtggtgcccgtgaagaacaccagcaacaccaagtaccgcctgatcagctgcaacaccagcgtgatcacccaggcctgccccaaggtgagcttccagcccatccccatccactactgcgtgcccgccggcttcgccatcctgaagtgcaacaacaagaccttcaacggcagcggcccctgcaccaacgtgagcaccgtgcagtgcacccacggcatccgccccgtggtgagcacccagctgctgctgaacggcagcctggccgaggaggacatcgtgatccgcagcgaggacttcaccgacaacgtgaagaccatcatcgtgcagctgaacgagagcgtggtgatcaactgcacccgccccaacaacaacacccgcgagcgcctgagcatcggccccggccgcgccttctacgcccgccgcaacatcatcggcgacatccgccaggcccactgcaacatcagccgcgccaagtggaacaacaccctgcagcagatcgtgatcaagctgcgcgagaagttccgcaacaagaccatcgccttcaaccagagcagcggcggcgaccccgagatcgtgatgcacagcttcaactgcggcggcgagttcttctactgcaacaccgcccagctgttcaacagcacctggaacgtggccggcggcaccaacggcaccgagggcaacgacatcatcaccctgcagtgccgcatcaagcagatcatcaacatgtggcagaaggtgggcaaggccatgtacgccccccccatcaccggccagatccgctgcagcagcaacatcaccggcctgctgctgacccgcgacggcggcaacagcaccgagaccgagaccgagatcttccgccccggcggcggcgacatgcgcgacaactggcgcagcgagctgtacaagtacaaggtggtgcgcatcgagcccatcggcgtggcccccacccgcgccaagcgccgcaccgtgcagcgcgagaagcgcgccgtgggcatcggcgccgtgttcctgggcttcctgggcgccgccggcagcaccatgggcgccgccagcgtgaccctgaccgtgcaggcccgcctgctgctgagcggcatcgtgcagcagcagaacaacctgctgcgcgccatcgaggcccagcagaacatgctgcgcctgaccgtgtggggcatcaagcagctgcaggcccgcgtgctggccctggagcgctacctgcgcgaccagcagctgatgggcatctggggctgcagcggcaagcttatctgcaccaccagcgtgccctggaacgtgagctggagcaacaagagcgtggacgacatctggaacaacatgacctggatggagtgggagcgcgagatcgacaactacaccgactacatctacgacctgctggagaagagccagacccagcaggagaagaacgagaaggagctgctggagctggacaagtgggccagcctgtggaactggttcgacatcaccaactggctgtggtacatccgcctgttcatcatgatcgtgggcggcctgatcggcctgcgcatcgtgttcgccgtgctgagcatcgtgaaccgcgtgcgccagggctacagccccctgagcttccagaccctgctgcccgccagccgcggccccgaccgccccgagggcaccgaggaggagggcggcgagcgcgaccgcgaccgcagcggccccagcgtgaacggcagcctggccctgatctgggacgacctgcgcagcctgtgcctgttcagctaccaccgcctgcgcgacctgctgctgatcgtgacccgcatcgtggagctgctgggccgccgcggctgggaggccctgaagtactggtggaacctgctgcagtactggagccaggagctgaagaacagcgccgtgagcctgctgcagtacggctggagctacttccacgaggccgtgcaggccgtgtggcgcagcgccaccgagaccctggccggcgcctggggcgacctgtgggagaccctgcgccgcggcggccgctggatcttggccatcccccgccgcatccgccagggcctggagctgaccctgctgtgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 88 - DNA, 6774 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtggagggcatccagcgcaactggaagcagtggtggatctggggcatcctgggcttctggatggtgatgatctacaacgtgcgcggcaacctgtgggtgaccgtgtactacggcgtgcccgtgtggaaggaggccaagaccaccctgttctgcgccagcgacgccaaggcctacgacgccgaggtgcacaacgtgtgggccacccacgcctgcgtgcccaccgaccccaacccccaggagatggtgctggagaacgtgaccgagaacttcaacatgtgggagaacgacatggtggagcagatgcaccaggacatcatcagcctgtgggaccagagcctgaagccctgcgtgaagctgacccccctgtgcgtgaccctgcactgcagcaaccgcaccatcgactacaacaaccgcaccgacaacatgggcggcgagatcaagaactgcagcttcaacatgaccaccgaggtgcgcgacaagcgcgagaaggtgcacgccctgttctaccgcctggacatcgtgcccctgaagaacgagagcagcaacaccagcggcgactaccgcctgatcaactgcaacaccagcgccatcacccaggcctgccccaaggtgagcttcgaccccatccccatccactactgcgcccccgccggctacgccatcctgaagtgcaacaacaagaccttcaacggcaccggcccctgcaacaacgtgagcaccatccagtgcacccacggcaccaagcccgtggtgagcacccagctgctgctgaacggcagcctggccgaggaggagatcatcatccgcagcaagaacctgaccgacaacgtgaagaccatcatcgtgcacctgaacgagagcgtggagatcaactgcacccgccccaacaacaacacccgcaagagcatccgcatcggccccggccaggccttctacgccaccggcgagatcatcggcgacatccgccaggcccactgcaacatcagccgcaccgcctggaacaagaccctgcaggaggtgggcaagaagctggccgagcacttccccaacaaggccatcaagttcgccaagcacagcggcggcgacctggagatcaccacccacagcttcaactgccgcggcgagttcttctactgcaacaccagcagcctgttcaacagcacctacacccccaacagcaccgagaacatcaccggcaccgagaacagcatcatcaccatcccctgccgcatcaagcagatcatcaacatgtggcagggcgtgggccgcgccatgtacgccccccccatcgagggcatcctgacctgccgcagcaacatcaccggcctgctgctgacccgcgacggcggcaccggcatgcacgacaccgagatcttccgcctgggcggcggcgacatgcgcgacaactggcgcagcgagctgtacaagtacaaggtggtgaagatcgagcccctgggcgtggcccccaccaaggccaagcttaccgtgcaggcccgccagctgctgagcggcatcgtgcagcagcagaacaacctgctgcgcgccatcgaggcccagcagcacctgctgcagctgaccgtgtggggcatcaagcagctgcaggcccgcatcctggccgtggagcgctacctgaaggaccagcagctggagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 89 - DNA, 6846 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtggagggcatccagcgcaactggaagcagtggtggatctggggcatcctgggcttctggatggtgatgatctacaacgtgcgcggcaacctgtgggtgaccgtgtactacggcgtgcccgtgtggaaggaggccaagaccaccctgttctgcgccagcgacgccaaggcctacgacgccgaggtgcacaacgtgtgggccacccacgcctgcgtgcccaccgaccccaacccccaggagatggtgctggagaacgtgaccgagaacttcaacatgtgggagaacgacatggtggagcagatgcaccaggacatcatcagcctgtgggaccagagcctgaagccctgcgtgaagctgacccccctgtgcgtgaccctgcactgcagcaaccgcaccatcgactacaacaaccgcaccgacaacatgggcggcgagatcaagaactgcagcttcaacatgaccaccgaggtgcgcgacaagcgcgagaaggtgcacgccctgttctaccgcctggacatcgtgcccctgaagaacgagagcagcaacaccagcggcgactaccgcctgatcaactgcaacaccagcgccatcacccaggcctgccccaaggtgagcttcgaccccatccccatccactactgcgcccccgccggctacgccatcctgaagtgcaacaacaagaccttcaacggcaccggcccctgcaacaacgtgagcaccatccagtgcacccacggcaccaagcccgtggtgagcacccagctgctgctgaacggcagcctggccgaggaggagatcatcatccgcagcaagaacctgaccgacaacgtgaagaccatcatcgtgcacctgaacgagagcgtggagatcaactgcacccgccccaacaacaacacccgcaagagcatccgcatcggccccggccaggccttctacgccaccggcgagatcatcggcgacatccgccaggcccactgcaacatcagccgcaccgcctggaacaagaccctgcaggaggtgggcaagaagctggccgagcacttccccaacaaggccatcaagttcgccaagcacagcggcggcgacctggagatcaccacccacagcttcaactgccgcggcgagttcttctactgcaacaccagcagcctgttcaacagcacctacacccccaacagcaccgagaacatcaccggcaccgagaacagcatcatcaccatcccctgccgcatcaagcagatcatcaacatgtggcagggcgtgggccgcgccatgtacgccccccccatcgagggcatcctgacctgccgcagcaacatcaccggcctgctgctgacccgcgacggcggcaccggcatgcacgacaccgagatcttccgcctgggcggcggcgacatgcgcgacaactggcgcagcgagctgtacaagtacaaggtggtgaagatcgagcccctgggcgtggcccccaccaaggccaagcttaccgtgcaggcccgccagctgctgagcggcatcgtgcagcagcagaacaacctgctgcgcgccatcgaggcccagcagcacctgctgcagctgaccgtgtggggcatcaagcagctgcaggcccgcatcctggccgtggagcgctacctgaaggaccagcagctggagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 90 - DNA, 6853 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtggagggcatccagcgcaactggaagcagtggtggatctggggcatcctgggcttctggatggtgatgatctacaacgtgcgcggcaacctgtgggtgaccgtgtactacggcgtgcccgtgtggaaggaggccaagaccaccctgttctgcgccagcgacgccaaggcctacgacgccgaggtgcacaacgtgtgggccacccacgcctgcgtgcccaccgaccccaacccccaggagatggtgctggagaacgtgaccgagaacttcaacatgtgggagaacgacatggtggagcagatgcaccaggacatcatcagcctgtgggaccagagcctgaagccctgcgtgaagctgacccccctgtgcgtgaccctgcactgcagcaaccgcaccatcgactacaacaaccgcaccgacaacatgggcggcgagatcaagaactgcagcttcaacatgaccaccgaggtgcgcgacaagcgcgagaaggtgcacgccctgttctaccgcctggacatcgtgcccctgaagaacgagagcagcaacaccagcggcgactaccgcctgatcaactgcaacaccagcgccatcacccaggcctgccccaaggtgagcttcgaccccatccccatccactactgcgcccccgccggctacgccatcctgaagtgcaacaacaagaccttcaacggcaccggcccctgcaacaacgtgagcaccatccagtgcacccacggcaccaagcccgtggtgagcacccagctgctgctgaacggcagcctggccgaggaggagatcatcatccgcagcaagaacctgaccgacaacgtgaagaccatcatcgtgcacctgaacgagagcgtggagatcaactgcacccgccccaacaacaacacccgcaagagcatccgcatcggccccggccaggccttctacgccaccggcgagatcatcggcgacatccgccaggcccactgcaacatcagccgcaccgcctggaacaagaccctgcaggaggtgggcaagaagctggccgagcacttccccaacaaggccatcaagttcgccaagcacagcggcggcgacctggagatcaccacccacagcttcaactgccgcggcgagttcttctactgcaacaccagcagcctgttcaacagcacctacacccccaacagcaccgagaacatcaccggcaccgagaacagcatcatcaccatcccctgccgcatcaagcagatcatcaacatgtggcagggcgtgggccgcgccatgtacgccccccccatcgagggcatcctgacctgccgcagcaacatcaccggcctgctgctgacccgcgacggcggcaccggcatgcacgacaccgagatcttccgccccgagggcggcgacatgcgcgacaactggcgcagcgagctgtacaagtacaaggtggtggagatcaagcccctgggcatcgcccccaccaaggccaagcttaccgtgcaggtgcgccagctgctgagcggcatcgtgcagcagcagagcaacctgctgcgcgccatcgaggcccagcagcacatgctgcagctgaccgtgtggggcatcaagcagctgcagacccgcgtgctggccatcgagcgctacctgcgcgaccagcagctcgaggacatctggaacaacatgacctggatgcagtgggaccgcgagatcagcaactacaccaacaccatctaccgcctgctggaggacagccagaaccagcaggagaagaacgagcaggacctgctggccctggacaagtggcagaacctgtggacctggttcggcatcaccaactggctgtggtacatcaagatcttcatcaagatcgtgggcggcctgatcggcctgcgcatcatcttcgccgtgctgagcatctgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 91 - DNA, 6761 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtgcgcggcatccagaccagctggcagaacctgtggcgctggggcaccatgatcctgggcatgctggtgatctacagcgccgccgagaacctgtgggtggccgtgtactacggcgtgcccgtgtggaaggacgccgagaccaccctgttctgcgccagcgacgccaaggcctacgacaccgaggtgcacaacgtgtgggagacccacgcctgcgtgcccaccgaccccaacccccaggaggtggacctggagaacgtgaccgaggacttcaacatgtggcgcaacaacatggtggagcagatgcacaccgacatcatcagcctgtgggaccagagcctgaagccctgcgtgaagctgacccccctgtgcgtgaccctggactgcaacgccaccgccagcaacgtgaccaacgagatgcgcaactgcagcttcaacatcaccaccgagctgaaggacaagaagcagcaggtgtacagcctgttctacaagctggacgtggtgcagatcaacgagaagaacgagaccgacaagtaccgcctgatcaactgcaacaccagcgccatcacccaggcctgccccaaggtgagcttcgagcccatccccatccactactgcgcccccgccggcttcgccatcctgaagtgcaaggacaccgagttcaacggcaccggcccctgcaagaacgtgagcaccgtgcagtgcacccacggcatccgccccgtgatcagcacccagctgctgctgaacggcagcctggccgaggagggcatccagatccgcagcgagaacatcaccaacaacgccaagaccatcatcgtgcagctggacaaggccgtgaagatcaactgcacccgccccaacaacaacacccgcaagggcgtgcgcatcggccccggccaggccttctacgccaccggcggcatcatcggcgacatccgccaggcccactgccacgtgagccgcgccaagtggaacgacaccctgcgcggcgtggccaagaagctgcgcgagcacttcaagaacaagaccatcatcttcgagaagagcagcggcggcgacatcgagatcaccacccacagcttcatctgcggcggcgagttcttctactgcaacaccagcggcctgttcaacagcacctgggagagcaacagcaccgagagcaacaacaccaccagcaacgacaccatcaccctgacctgccgcatcaagcagatcatcaacatgtggcagaaggtgggccaggccatgtaccccccccccatccagggcgtgatccgctgcgagagcaacatcaccggcctgctgctgacccgcgacggcggcaacaacagcaccaacgagatcttccgccccggcggcggcaacatgcgcgacaactggcgcagcgagctgtacaagtacaaggtggtgaagatcgagcccctgggcgtggcccccagccgcgccaagcttaccgcccaggcccgccagctgctgagcggcatcgtgcagcagcagagcaacctgctgcgcgccatcgaggcccagcagcacatgctgaagctgaccgtgtggggcatcaagcagctgcaggcccgcgtgctggccgtggagcgctacctgaaggaccagcagctcgagatctgggacaacatgacctggctgcagtgggacaaggagatcagcaactacacccagatcatctacaacctgatcgaggagagccagaaccagcaggagaagaacgagcaggacctgctggccctggacaagtgggccagcctgtggaactggttcgacatcagccgctggctgtggtgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 92 - DNA, 6836 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtgcgcggcatccagaccagctggcagaacctgtggcgctggggcaccatgatcctgggcatgctggtgatctacagcgccgccgagaacctgtgggtggccgtgtactacggcgtgcccgtgtggaaggacgccgagaccaccctgttctgcgccagcgacgccaaggcctacgacaccgaggtgcacaacgtgtgggagacccacgcctgcgtgcccaccgaccccaacccccaggaggtggacctggagaacgtgaccgaggacttcaacatgtggcgcaacaacatggtggagcagatgcacaccgacatcatcagcctgtgggaccagagcctgaagccctgcgtgaagctgacccccctgtgcgtgaccctggactgcaacgccaccgccagcaacgtgaccaacgagatgcgcaactgcagcttcaacatcaccaccgagctgaaggacaagaagcagcaggtgtacagcctgttctacaagctggacgtggtgcagatcaacgagaagaacgagaccgacaagtaccgcctgatcaactgcaacaccagcgccatcacccaggcctgccccaaggtgagcttcgagcccatccccatccactactgcgcccccgccggcttcgccatcctgaagtgcaaggacaccgagttcaacggcaccggcccctgcaagaacgtgagcaccgtgcagtgcacccacggcatccgccccgtgatcagcacccagctgctgctgaacggcagcctggccgaggagggcatccagatccgcagcgagaacatcaccaacaacgccaagaccatcatcgtgcagctggacaaggccgtgaagatcaactgcacccgccccaacaacaacacccgcaagggcgtgcgcatcggccccggccaggccttctacgccaccggcggcatcatcggcgacatccgccaggcccactgccacgtgagccgcgccaagtggaacgacaccctgcgcggcgtggccaagaagctgcgcgagcacttcaagaacaagaccatcatcttcgagaagagcagcggcggcgacatcgagatcaccacccacagcttcatctgcggcggcgagttcttctactgcaacaccagcggcctgttcaacagcacctgggagagcaacagcaccgagagcaacaacaccaccagcaacgacaccatcaccctgacctgccgcatcaagcagatcatcaacatgtggcagaaggtgggccaggccatgtaccccccccccatccagggcgtgatccgctgcgagagcaacatcaccggcctgctgctgacccgcgacggcggcaacaacagcaccaacgagatcttccgccccggcggcggcaacatgcgcgacaactggcgcagcgagctgtacaagtacaaggtggtgaagatcgagcccctgggcgtggcccccagccgcgccaagcttaccgcccaggcccgccagctgctgagcggcatcgtgcagcagcagagcaacctgctgcgcgccatcgaggcccagcagcacatgctgaagctgaccgtgtggggcatcaagcagctgcaggcccgcgtgctggccgtggagcgctacctgaaggaccagcagctcgagatctgggacaacatgacctggctgcagtgggacaaggagatcagcaactacacccagatcatctacaacctgatcgaggagagccagaaccagcaggagaagaacgagcaggacctgctggccctggacaagtgggccagcctgtggaactggttcgacatcagccgctggctgtggtacatcaagatcttcatcatgatcgtgggcggcctgatcggcctgcgcatcgtgttcgccgtgctgagcgtgatctgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 93 - DNA, 6800 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtgaaggagacccagatgaactggcctaacctgtggaagtggggcatcctgatcctgggcctggtgatcatctgcagcgccagcgacaacctgtgggtgaccgtgtactacggcgtgcccgtgtggcgcgacgccgacaccaccctgttctgcgccagcgacgccaaggcccacgagaccgaggtgcacaacgtgtgggccacccacgcctgcgtgcccaccgaccccaacccccaggaggtggacctggagaacatcaccgagaacttcaacatgtggaagaacaacatggtggagcagatgcaggaggacgtgatcagcctgtgggaccagagcctgaagccctgcgtgaagctgacccccctgtgcgtgaccctgaactgcatcaacgccaacctgaccaacgtgaacaacatcatccacggccccaacatcatcggcaacatcaccgacgaggtgcgcaactgcagcttcaacatgaccaccgagatccgcgacaagaagcagaaggtgcacgccctgttctacaagctggacctggtgcagatcgaggacaagaacagcagcgagtaccgcctgatcaactgcaacaccagcgtgatcaagcaggcctgccccaagatcagcttcgaccccatccccatccactactgcacccccgccggctacgccatcctgaagtgcaacgacaagaacttcaacggcaccggcccctgcaccaacgtgagcagcgtgcagtgcacccacggcatcaagcccgtggtgagcacccagctgctgctgaacggcagcctggccgaggaggagatcatcatccgcagcgagaacctgaccaacaacgccaagaccatcatcgtgcacctgaacaagagcgtggagatcaactgcacccgccccagcaacaacacccgcaccagcaccaccatcggccccggccaggtgttctaccgcaccggcgacatcaccggcaacatccgcaaggcctactgcgagatcaacggcaccaagtggaacgaggccctgaagcaggtgaccaagaagctgaaggagcacttcaacaacaagaccatcatcttccagccccccagcggcggcgacctggagatcaccatgcaccacttcaactgccgcggcgagttcttctactgcaacaccacccgcctgttcaacaacacctgcatcggcaacgagaccatcggcggctgcaacgacaccatcatcctgccctgcaagatcaagcagatcatcaacatgtggcagggcgccggcctggccatgtacgccccccccatcagcggccgcatcaactgcgtgagcaacatcaccggcatcctgctgacccgcgacggcggcgccaacaacaccagcaacgagatcttccgccccggcggcggcaacatcaaggacaactggcgcagcgagctgtacaagtacaaggtggtgcagatcgagcccctgggcatcgcccccacccgcgccaagcttaccgtgcaggcccgccagctggtgagcggcatcgtgcagcagcagagcaacctgctgcgcgccatcgaggcccagcagcacctgctgcagctgaccgtgtggggcatcaagcagctgcaggcccgcgtgctggccgtggagcgctacctgaaggaccagaagttcctcgaggagatctggagcaacatgacctggatcgagtgggagcgcgagatcagcaactacaccaaccagatctacgagatcctgaccgagagccagaaccagcaggaccgcaacgagaaggacctgctggagctggacaagtgggcgagcctgtggagctggttcgacatcaccaactggctgtggtgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 94 - DNA, 6872 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtgaaggagacccagatgaactggcctaacctgtggaagtggggcatcctgatcctgggcctggtgatcatctgcagcgccagcgacaacctgtgggtgaccgtgtactacggcgtgcccgtgtggcgcgacgccgacaccaccctgttctgcgccagcgacgccaaggcccacgagaccgaggtgcacaacgtgtgggccacccacgcctgcgtgcccaccgaccccaacccccaggaggtggacctggagaacatcaccgagaacttcaacatgtggaagaacaacatggtggagcagatgcaggaggacgtgatcagcctgtgggaccagagcctgaagccctgcgtgaagctgacccccctgtgcgtgaccctgaactgcatcaacgccaacctgaccaacgtgaacaacatcatccacggccccaacatcatcggcaacatcaccgacgaggtgcgcaactgcagcttcaacatgaccaccgagatccgcgacaagaagcagaaggtgcacgccctgttctacaagctggacctggtgcagatcgaggacaagaacagcagcgagtaccgcctgatcaactgcaacaccagcgtgatcaagcaggcctgccccaagatcagcttcgaccccatccccatccactactgcacccccgccggctacgccatcctgaagtgcaacgacaagaacttcaacggcaccggcccctgcaccaacgtgagcagcgtgcagtgcacccacggcatcaagcccgtggtgagcacccagctgctgctgaacggcagcctggccgaggaggagatcatcatccgcagcgagaacctgaccaacaacgccaagaccatcatcgtgcacctgaacaagagcgtggagatcaactgcacccgccccagcaacaacacccgcaccagcaccaccatcggccccggccaggtgttctaccgcaccggcgacatcaccggcaacatccgcaaggcctactgcgagatcaacggcaccaagtggaacgaggccctgaagcaggtgaccaagaagctgaaggagcacttcaacaacaagaccatcatcttccagccccccagcggcggcgacctggagatcaccatgcaccacttcaactgccgcggcgagttcttctactgcaacaccacccgcctgttcaacaacacctgcatcggcaacgagaccatcggcggctgcaacgacaccatcatcctgccctgcaagatcaagcagatcatcaacatgtggcagggcgccggcctggccatgtacgccccccccatcagcggccgcatcaactgcgtgagcaacatcaccggcatcctgctgacccgcgacggcggcgccaacaacaccagcaacgagatcttccgccccggcggcggcaacatcaaggacaactggcgcagcgagctgtacaagtacaaggtggtgcagatcgagcccctgggcatcgcccccacccgcgccaagcttaccgtgcaggcccgccagctggtgagcggcatcgtgcagcagcagagcaacctgctgcgcgccatcgaggcccagcagcacctgctgcagctgaccgtgtggggcatcaagcagctgcaggcccgcgtgctggccgtggagcgctacctgaaggaccagaagttcctcgaggagatctggagcaacatgacctggatcgagtgggagcgcgagatcagcaactacaccaaccagatctacgagatcctgaccgagagccagaaccagcaggaccgcaacgagaaggacctgctggagctggacaagtgggcgagcctgtggagctggttcgacatcaccaactggctgtggtacatcaagatcttcatcatgatcgtgggcggcctgatcggcctgcgcatcatcttcgccgtgctgagcatctgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 95 - DNA, 6757 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctaccttcaaaaacaacgttaccaacgacatgaacaaagaaatccgtaactgctccttcaacaccaccaccgaaatccgtgacaaaaaacagcagggttacgctctgttctaccgtccggacatcgttctgctgaaagaaaaccgtaacaactccaacaactccgaatacatcctgatcaactgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtccgaacaacaacacccgtaaatccatgcgtatcggtccgggtcagaccttctacgctaccggtgacatcatcggtgacatccgtcaggcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccacccgtctgttcaacaacaacgctaccgaagacgaaaccatcaccctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 96 - DNA, 6829 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctaccttcaaaaacaacgttaccaacgacatgaacaaagaaatccgtaactgctccttcaacaccaccaccgaaatccgtgacaaaaaacagcagggttacgctctgttctaccgtccggacatcgttctgctgaaagaaaaccgtaacaactccaacaactccgaatacatcctgatcaactgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtccgaacaacaacacccgtaaatccatgcgtatcggtccgggtcagaccttctacgctaccggtgacatcatcggtgacatccgtcaggcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccacccgtctgttcaacaacaacgctaccgaagacgaaaccatcaccctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtacatcaaaatcttcatcatgatcgttggtggtctgatcggtctgcgtatcatcttcgctgttctgtccatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 97 - DNA, 6752 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtggagggcatccagcgcaactggaagcagtggtggatctggggcatcctgggcttctggatggtgatgatctacaacgtgcgcggcaacctgtgggtgaccgtgtactacggcgtgcccgtgtggaaggaggccaagaccaccctgttctgcgccagcgacgccaaggcctacgacgccgaggtgcacaacgtgtgggccacccacgcctgcgtgcccaccgaccccaacccccaggagatggtgctggagaacgtgaccgagaacttcaacatgtgggagaacgacatggtggagcagatgcaccaggacatcatcagcctgtgggaccagagcctgaagccctgcgtgaagctgacccccctgtgcgtgaccctgcactgcagcaaccgatcgaagaactgcagcttcaacatgaccaccgaggtgcgcgacaagcgcgagaaggtgcacgccctgttctaccgcctggacatcgtgcccctgaagaacgagagcagcaacaccagcggcgactaccgcctgatcaactgcaacaccagcgccatcacccaggcctgccccaaggtgagcttcgaccccatccccatccactactgcgcccccgccggctacgccatcctgaagtgcaacaacaagaccttcaacggcaccggcccctgcaacaacgtgagcaccatccagtgcacccacggcaccaagcccgtggtgagcacccagctgctgctgaacggcagcctggccgaggaggagatcatcatccgcagcaagaacctgaccgacaacgtgaagaccatcatcgtgcacctgaacgagagcgtggagatcaactgcacccgccccaacaacaacacccgcaagagcatccgcatcggccccggccaggccttctacgccaccggcgagatcatcggcgacatccgccaggcccactgcaacatcagccgcaccgcctggaacaagaccctgcaggaggtgggcaagaagctggccgagcacttccccaacaaggccatcaagttcgccaagcacagcggcggcgacctggagatcaccacccacagcttcaactgccgcggcgagttcttctactgcaacaccagcagcctgttcaacagcacctacacccccaacagcaccgagaacatcaccggcaccgagaacagcatcatcaccatcccctgccgcatcaagcagatcatcaacatgtggcagggcgtgggccgcgccatgtacgccccccccatcgagggcatcctgacctgccgcagcaacatcaccggcctgctgctgacccgcgacggcggcaccggcatgcacgacaccgagatcttccgccccgagggcggcgacatgcgcgacaactggcgcagcgagctgtacaagtacaaggtggtggagatcaagcccctgggcatcgcccccaccaaggccaagcttaccgtgcaggtgcgccagctgctgagcggcatcgtgcagcagcagagcaacctgctgcgcgccatcgaggcccagcagcacatgctgcagctgaccgtgtggggcatcaagcagctgcagacccgcgtgctggccatcgagcgctacctgcgcgaccagcagctcgaggacatctggaacaacatgacctggatgcagtgggaccgcgagatcagcaactacaccaacaccatctaccgcctgctggaggacagccagaaccagcaggagaagaacgagcaggacctgctggccctggacaagtggcagaacctgtggacctggttcggcatcaccaactggctgtggtgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 98 - DNA, 6623 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtggagggcatccagcgcaactggaagcagtggtggatctggggcatcctgggcttctggatggtgatgatctacaacgtgcgcggcaacctgtgggtgaccgtgtactacggcgtgcccgtgtggaaggaggccaagaccaccctgttctgcgccagcgacgccaaggcctacgacgccgaggtgcacaacgtgtgggccacccacgcctgcgtgcccaccgaccccaacccccaggagatggtgctggagaacgtgaccgagaacttcaacatgtgggagaacgacatggtggagcagatgcaccaggacatcatcagcctgtgggaccagagcctgaagccctgcgtgaagctgacccccctgtgcgtgaccctgcactgcagcaaccgatcgatcaactgcaacaccagcgccatcacccaggcctgccccaaggtgagcttcgaccccatccccatccactactgcgcccccgccggctacgccatcctgaagtgcaacaacaagaccttcaacggcaccggcccctgcaacaacgtgagcaccatccagtgcacccacggcaccaagcccgtggtgagcacccagctgctgctgaacggcagcctggccgaggaggagatcatcatccgcagcaagaacctgaccgacaacgtgaagaccatcatcgtgcacctgaacgagagcgtggagatcaactgcacccgccccaacaacaacacccgcaagagcatccgcatcggccccggccaggccttctacgccaccggcgagatcatcggcgacatccgccaggcccactgcaacatcagccgcaccgcctggaacaagaccctgcaggaggtgggcaagaagctggccgagcacttccccaacaaggccatcaagttcgccaagcacagcggcggcgacctggagatcaccacccacagcttcaactgccgcggcgagttcttctactgcaacaccagcagcctgttcaacagcacctacacccccaacagcaccgagaacatcaccggcaccgagaacagcatcatcaccatcccctgccgcatcaagcagatcatcaacatgtggcagggcgtgggccgcgccatgtacgccccccccatcgagggcatcctgacctgccgcagcaacatcaccggcctgctgctgacccgcgacggcggcaccggcatgcacgacaccgagatcttccgccccgagggcggcgacatgcgcgacaactggcgcagcgagctgtacaagtacaaggtggtggagatcaagcccctgggcatcgcccccaccaaggccaagcttaccgtgcaggtgcgccagctgctgagcggcatcgtgcagcagcagagcaacctgctgcgcgccatcgaggcccagcagcacatgctgcagctgaccgtgtggggcatcaagcagctgcagacccgcgtgctggccatcgagcgctacctgcgcgaccagcagctcgaggacatctggaacaacatgacctggatgcagtgggaccgcgagatcagcaactacaccaacaccatctaccgcctgctggaggacagccagaaccagcaggagaagaacgagcaggacctgctggccctggacaagtggcagaacctgtggacctggttcggcatcaccaactggctgtggtgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 99 - DNA, 6542 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtggagggcatccagcgcaactggaagcagtggtggatctggggcatcctgggcttctggatggtgatgatctacaacgtgcgcggcaacctgtgggtgaccgtgtactacggcgtgcccgtgtggaaggaggccaagaccaccctgttctgcgccagcgacgccaaggcctacgacgccgaggtgcacaacgtgtgggccacccacgcctgcgtgcccaccgaccccaacccccaggagatggtgctggagaacgtgaccgagaacttcaacatgtgggagaacgacatggtggagcagatgcaccaggacatcatcagcctgtgggaccagagcctgaagccctgcgtgaagctgacccccctgtgcgtgaccctgcactgcagcaaccgatcgatcaactgcaacaccagcgccatcacccaggcctgccccaaggtgagcttcgaccccatccccatccactactgcgcccccgccggctacgccatcctgaagtgcaacaacaagaccttcaacggcaccggcccctgcaacaacgtgagcaccatccagtgcacccacggcaccaagcccgtggtgagcacccagctgctgctgaacggcagcctggccgaggaggagatcatcatccgcagcaagaacctgaccgacaacgtgaagaccatcatcgtgcacctgaacgagagcgtggagatcaactgcacccgccgatcggcccactgcaacatcagccgcaccgcctggaacaagaccctgcaggaggtgggcaagaagctggccgagcacttccccaacaaggccatcaagttcgccaagcacagcggcggcgacctggagatcaccacccacagcttcaactgccgcggcgagttcttctactgcaacaccagcagcctgttcaacagcacctacacccccaacagcaccgagaacatcaccggcaccgagaacagcatcatcaccatcccctgccgcatcaagcagatcatcaacatgtggcagggcgtgggccgcgccatgtacgccccccccatcgagggcatcctgacctgccgcagcaacatcaccggcctgctgctgacccgcgacggcggcaccggcatgcacgacaccgagatcttccgccccgagggcggcgacatgcgcgacaactggcgcagcgagctgtacaagtacaaggtggtggagatcaagcccctgggcatcgcccccaccaaggccaagcttaccgtgcaggtgcgccagctgctgagcggcatcgtgcagcagcagagcaacctgctgcgcgccatcgaggcccagcagcacatgctgcagctgaccgtgtggggcatcaagcagctgcagacccgcgtgctggccatcgagcgctacctgcgcgaccagcagctcgaggacatctggaacaacatgacctggatgcagtgggaccgcgagatcagcaactacaccaacaccatctaccgcctgctggaggacagccagaaccagcaggagaagaacgagcaggacctgctggccctggacaagtggcagaacctgtggacctggttcggcatcaccaactggctgtggtgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 100 - DNA, 6473 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtggagggcatccagcgcaactggaagcagtggtggatctggggcatcctgggcttctggatggtgatgatctacaacgtgcgcggcaacctgtgggtgaccgtgtactacggcgtgcccgtgtggaaggaggccaagaccaccctgttctgcgccagcgacgccaaggcctacgacgccgaggtgcacaacgtgtgggccacccacgcctgcgtgcccaccgaccccaacccccaggagatggtgctggagaacgtgaccgagaacttcaacatgtgggagaacgacatggtggagcagatgcaccaggacatcatcagcctgtgggaccagagcctgaagccctgcgtgaagctgacccccctgtgcgtgaccctgcactgcagcaaccgatcgatcaactgcaacaccagcgccatcacccaggcctgccccaaggtgagcttcgaccccatccccatccactactgcgcccccgccggctacgccatcctgaagtgcaacaacaagaccttcaacggcaccggcccctgcaacaacgtgagcaccatccagtgcacccacggcaccaagcccgtggtgagcacccagctgctgctgaacggcagcctggccgaggaggagatcatcatccgcagcaagaacctgaccgacaacgtgaagaccatcatcgtgcacctgaacgagagcgtggagatcaactgcacccgccgatcggcccactgcaacatcagccgcaccgcctggaacaagaccctgcaggaggtgggcaagaagctggccgagcacttccccaacaaggccatcaagttcgccaagcacagcggcggcgacctggagatcaccacccacagcttcaactgccgcggcgagttcttctactgcaacacccgatcgatcccctgccgcatcaagcagatcatcaacatgtggcagggcgtgggccgcgccatgtacgccccccccatcgagggcatcctgacctgccgcagcaacatcaccggcctgctgctgacccgcgacggcggcaccggcatgcacgacaccgagatcttccgccccgagggcggcgacatgcgcgacaactggcgcagcgagctgtacaagtacaaggtggtggagatcaagcccctgggcatcgcccccaccaaggccaagcttaccgtgcaggtgcgccagctgctgagcggcatcgtgcagcagcagagcaacctgctgcgcgccatcgaggcccagcagcacatgctgcagctgaccgtgtggggcatcaagcagctgcagacccgcgtgctggccatcgagcgctacctgcgcgaccagcagctcgaggacatctggaacaacatgacctggatgcagtgggaccgcgagatcagcaactacaccaacaccatctaccgcctgctggaggacagccagaaccagcaggagaagaacgagcaggacctgctggccctggacaagtggcagaacctgtggacctggttcggcatcaccaactggctgtggtgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 101 - DNA, 6554 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtggagggcatccagcgcaactggaagcagtggtggatctggggcatcctgggcttctggatggtgatgatctacaacgtgcgcggcaacctgtgggtgaccgtgtactacggcgtgcccgtgtggaaggaggccaagaccaccctgttctgcgccagcgacgccaaggcctacgacgccgaggtgcacaacgtgtgggccacccacgcctgcgtgcccaccgaccccaacccccaggagatggtgctggagaacgtgaccgagaacttcaacatgtgggagaacgacatggtggagcagatgcaccaggacatcatcagcctgtgggaccagagcctgaagccctgcgtgaagctgacccccctgtgcgtgaccctgcactgcagcaaccgatcgatcaactgcaacaccagcgccatcacccaggcctgccccaaggtgagcttcgaccccatccccatccactactgcgcccccgccggctacgccatcctgaagtgcaacaacaagaccttcaacggcaccggcccctgcaacaacgtgagcaccatccagtgcacccacggcaccaagcccgtggtgagcacccagctgctgctgaacggcagcctggccgaggaggagatcatcatccgcagcaagaacctgaccgacaacgtgaagaccatcatcgtgcacctgaacgagagcgtggagatcaactgcacccgccccaacaacaacacccgcaagagcatccgcatcggccccggccaggccttctacgccaccggcgagatcatcggcgacatccgccaggcccactgcaacatcagccgcaccgcctggaacaagaccctgcaggaggtgggcaagaagctggccgagcacttccccaacaaggccatcaagttcgccaagcacagcggcggcgacctggagatcaccacccacagcttcaactgccgcggcgagttcttctactgcaacacccgatcgatcccctgccgcatcaagcagatcatcaacatgtggcagggcgtgggccgcgccatgtacgccccccccatcgagggcatcctgacctgccgcagcaacatcaccggcctgctgctgacccgcgacggcggcaccggcatgcacgacaccgagatcttccgccccgagggcggcgacatgcgcgacaactggcgcagcgagctgtacaagtacaaggtggtggagatcaagcccctgggcatcgcccccaccaaggccaagcttaccgtgcaggtgcgccagctgctgagcggcatcgtgcagcagcagagcaacctgctgcgcgccatcgaggcccagcagcacatgctgcagctgaccgtgtggggcatcaagcagctgcagacccgcgtgctggccatcgagcgctacctgcgcgaccagcagctcgaggacatctggaacaacatgacctggatgcagtgggaccgcgagatcagcaactacaccaacaccatctaccgcctgctggaggacagccagaaccagcaggagaagaacgagcaggacctgctggccctggacaagtggcagaacctgtggacctggttcggcatcaccaactggctgtggtgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 102 - DNA, 6671 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtggagggcatccagcgcaactggaagcagtggtggatctggggcatcctgggcttctggatggtgatgatctacaacgtgcgcggcaacctgtgggtgaccgtgtactacggcgtgcccgtgtggaaggaggccaagaccaccctgttctgcgccagcgacgccaaggcctacgacgccgaggtgcacaacgtgtgggccacccacgcctgcgtgcccaccgaccccaacccccaggagatggtgctggagaacgtgaccgagaacttcaacatgtgggagaacgacatggtggagcagatgcaccaggacatcatcagcctgtgggaccagagcctgaagccctgcgtgaagctgacccccctgtgcgtgaccctgcactgcagcaaccgatcgaagaactgcagcttcaacatgaccaccgaggtgcgcgacaagcgcgagaaggtgcacgccctgttctaccgcctggacatcgtgcccctgaagaacgagagcagcaacaccagcggcgactaccgcctgatcaactgcaacaccagcgccatcacccaggcctgccccaaggtgagcttcgaccccatccccatccactactgcgcccccgccggctacgccatcctgaagtgcaacaacaagaccttcaacggcaccggcccctgcaacaacgtgagcaccatccagtgcacccacggcaccaagcccgtggtgagcacccagctgctgctgaacggcagcctggccgaggaggagatcatcatccgcagcaagaacctgaccgacaacgtgaagaccatcatcgtgcacctgaacgagagcgtggagatcaactgcacccgccgatcggcccactgcaacatcagccgcaccgcctggaacaagaccctgcaggaggtgggcaagaagctggccgagcacttccccaacaaggccatcaagttcgccaagcacagcggcggcgacctggagatcaccacccacagcttcaactgccgcggcgagttcttctactgcaacaccagcagcctgttcaacagcacctacacccccaacagcaccgagaacatcaccggcaccgagaacagcatcatcaccatcccctgccgcatcaagcagatcatcaacatgtggcagggcgtgggccgcgccatgtacgccccccccatcgagggcatcctgacctgccgcagcaacatcaccggcctgctgctgacccgcgacggcggcaccggcatgcacgacaccgagatcttccgccccgagggcggcgacatgcgcgacaactggcgcagcgagctgtacaagtacaaggtggtggagatcaagcccctgggcatcgcccccaccaaggccaagcttaccgtgcaggtgcgccagctgctgagcggcatcgtgcagcagcagagcaacctgctgcgcgccatcgaggcccagcagcacatgctgcagctgaccgtgtggggcatcaagcagctgcagacccgcgtgctggccatcgagcgctacctgcgcgaccagcagctcgaggacatctggaacaacatgacctggatgcagtgggaccgcgagatcagcaactacaccaacaccatctaccgcctgctggaggacagccagaaccagcaggagaagaacgagcaggacctgctggccctggacaagtggcagaacctgtggacctggttcggcatcaccaactggctgtggtgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 103 - DNA, 6602 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtggagggcatccagcgcaactggaagcagtggtggatctggggcatcctgggcttctggatggtgatgatctacaacgtgcgcggcaacctgtgggtgaccgtgtactacggcgtgcccgtgtggaaggaggccaagaccaccctgttctgcgccagcgacgccaaggcctacgacgccgaggtgcacaacgtgtgggccacccacgcctgcgtgcccaccgaccccaacccccaggagatggtgctggagaacgtgaccgagaacttcaacatgtgggagaacgacatggtggagcagatgcaccaggacatcatcagcctgtgggaccagagcctgaagccctgcgtgaagctgacccccctgtgcgtgaccctgcactgcagcaaccgatcgaagaactgcagcttcaacatgaccaccgaggtgcgcgacaagcgcgagaaggtgcacgccctgttctaccgcctggacatcgtgcccctgaagaacgagagcagcaacaccagcggcgactaccgcctgatcaactgcaacaccagcgccatcacccaggcctgccccaaggtgagcttcgaccccatccccatccactactgcgcccccgccggctacgccatcctgaagtgcaacaacaagaccttcaacggcaccggcccctgcaacaacgtgagcaccatccagtgcacccacggcaccaagcccgtggtgagcacccagctgctgctgaacggcagcctggccgaggaggagatcatcatccgcagcaagaacctgaccgacaacgtgaagaccatcatcgtgcacctgaacgagagcgtggagatcaactgcacccgccgatcggcccactgcaacatcagccgcaccgcctggaacaagaccctgcaggaggtgggcaagaagctggccgagcacttccccaacaaggccatcaagttcgccaagcacagcggcggcgacctggagatcaccacccacagcttcaactgccgcggcgagttcttctactgcaacacccgatcgatcccctgccgcatcaagcagatcatcaacatgtggcagggcgtgggccgcgccatgtacgccccccccatcgagggcatcctgacctgccgcagcaacatcaccggcctgctgctgacccgcgacggcggcaccggcatgcacgacaccgagatcttccgccccgagggcggcgacatgcgcgacaactggcgcagcgagctgtacaagtacaaggtggtggagatcaagcccctgggcatcgcccccaccaaggccaagcttaccgtgcaggtgcgccagctgctgagcggcatcgtgcagcagcagagcaacctgctgcgcgccatcgaggcccagcagcacatgctgcagctgaccgtgtggggcatcaagcagctgcagacccgcgtgctggccatcgagcgctacctgcgcgaccagcagctcgaggacatctggaacaacatgacctggatgcagtgggaccgcgagatcagcaactacaccaacaccatctaccgcctgctggaggacagccagaaccagcaggagaagaacgagcaggacctgctggccctggacaagtggcagaacctgtggacctggttcggcatcaccaactggctgtggtgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 104 - DNA, 6683 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtggagggcatccagcgcaactggaagcagtggtggatctggggcatcctgggcttctggatggtgatgatctacaacgtgcgcggcaacctgtgggtgaccgtgtactacggcgtgcccgtgtggaaggaggccaagaccaccctgttctgcgccagcgacgccaaggcctacgacgccgaggtgcacaacgtgtgggccacccacgcctgcgtgcccaccgaccccaacccccaggagatggtgctggagaacgtgaccgagaacttcaacatgtgggagaacgacatggtggagcagatgcaccaggacatcatcagcctgtgggaccagagcctgaagccctgcgtgaagctgacccccctgtgcgtgaccctgcactgcagcaaccgatcgaagaactgcagcttcaacatgaccaccgaggtgcgcgacaagcgcgagaaggtgcacgccctgttctaccgcctggacatcgtgcccctgaagaacgagagcagcaacaccagcggcgactaccgcctgatcaactgcaacaccagcgccatcacccaggcctgccccaaggtgagcttcgaccccatccccatccactactgcgcccccgccggctacgccatcctgaagtgcaacaacaagaccttcaacggcaccggcccctgcaacaacgtgagcaccatccagtgcacccacggcaccaagcccgtggtgagcacccagctgctgctgaacggcagcctggccgaggaggagatcatcatccgcagcaagaacctgaccgacaacgtgaagaccatcatcgtgcacctgaacgagagcgtggagatcaactgcacccgccccaacaacaacacccgcaagagcatccgcatcggccccggccaggccttctacgccaccggcgagatcatcggcgacatccgccaggcccactgcaacatcagccgcaccgcctggaacaagaccctgcaggaggtgggcaagaagctggccgagcacttccccaacaaggccatcaagttcgccaagcacagcggcggcgacctggagatcaccacccacagcttcaactgccgcggcgagttcttctactgcaacacccgatcgatcccctgccgcatcaagcagatcatcaacatgtggcagggcgtgggccgcgccatgtacgccccccccatcgagggcatcctgacctgccgcagcaacatcaccggcctgctgctgacccgcgacggcggcaccggcatgcacgacaccgagatcttccgccccgagggcggcgacatgcgcgacaactggcgcagcgagctgtacaagtacaaggtggtggagatcaagcccctgggcatcgcccccaccaaggccaagcttaccgtgcaggtgcgccagctgctgagcggcatcgtgcagcagcagagcaacctgctgcgcgccatcgaggcccagcagcacatgctgcagctgaccgtgtggggcatcaagcagctgcagacccgcgtgctggccatcgagcgctacctgcgcgaccagcagctcgaggacatctggaacaacatgacctggatgcagtgggaccgcgagatcagcaactacaccaacaccatctaccgcctgctggaggacagccagaaccagcaggagaagaacgagcaggacctgctggccctggacaagtggcagaacctgtggacctggttcggcatcaccaactggctgtggtgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 105 - DNA, 6605 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtggagggcatccagcgcaactggaagcagtggtggatctggggcatcctgggcttctggatggtgatgatctacaacgtgcgcggcaacctgtgggtgaccgtgtactacggcgtgcccgtgtggaaggaggccaagaccaccctgttctgcgccagcgacgccaaggcctacgacgccgaggtgcacaacgtgtgggccacccacgcctgcgtgcccaccgaccccaacccccaggagatggtgctggagaacgtgaccgagaacttcaacatgtgggagaacgacatggtggagcagatgcaccaggacatcatcagcctgtgggaccagagcctgaagccctgcgtgaagctgacccccctgtgcgtgaccctgcactgcagcaaccgcaccatcgactacaacaaccgcaccgacaacatgggcggcgagatcaagaactgcagcttccgatcgatcaactgcaacaccagcgccatcacccaggcctgccccaaggtgagcttcgaccccatccccatccactactgcgcccccgccggctacgccatcctgaagtgcaacaacaagaccttcaacggcaccggcccctgcaacaacgtgagcaccatccagtgcacccacggcaccaagcccgtggtgagcacccagctgctgctgaacggcagcctggccgaggaggagatcatcatccgcagcaagaacctgaccgacaacgtgaagaccatcatcgtgcacctgaacgagagcgtggagatcaactgcacccgccgatcggcccactgcaacatcagccgcaccgcctggaacaagaccctgcaggaggtgggcaagaagctggccgagcacttccccaacaaggccatcaagttcgccaagcacagcggcggcgacctggagatcaccacccacagcttcaactgccgcggcgagttcttctactgcaacaccagcagcctgttcaacagcacctacacccccaacagcaccgagaacatcaccggcaccgagaacagcatcatcaccatcccctgccgcatcaagcagatcatcaacatgtggcagggcgtgggccgcgccatgtacgccccccccatcgagggcatcctgacctgccgcagcaacatcaccggcctgctgctgacccgcgacggcggcaccggcatgcacgacaccgagatcttccgccccgagggcggcgacatgcgcgacaactggcgcagcgagctgtacaagtacaaggtggtggagatcaagcccctgggcatcgcccccaccaaggccaagcttaccgtgcaggtgcgccagctgctgagcggcatcgtgcagcagcagagcaacctgctgcgcgccatcgaggcccagcagcacatgctgcagctgaccgtgtggggcatcaagcagctgcagacccgcgtgctggccatcgagcgctacctgcgcgaccagcagctcgaggacatctggaacaacatgacctggatgcagtgggaccgcgagatcagcaactacaccaacaccatctaccgcctgctggaggacagccagaaccagcaggagaagaacgagcaggacctgctggccctggacaagtggcagaacctgtggacctggttcggcatcaccaactggctgtggtgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 106 - DNA, 6605 bp, Artificial Sequence; identical to SEQ ID NO: 105
  plasmid pVR1012x/s containing HIV genes

SEQ ID NO: 107 - DNA, 6536 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtggagggcatccagcgcaactggaagcagtggtggatctggggcatcctgggcttctggatggtgatgatctacaacgtgcgcggcaacctgtgggtgaccgtgtactacggcgtgcccgtgtggaaggaggccaagaccaccctgttctgcgccagcgacgccaaggcctacgacgccgaggtgcacaacgtgtgggccacccacgcctgcgtgcccaccgaccccaacccccaggagatggtgctggagaacgtgaccgagaacttcaacatgtgggagaacgacatggtggagcagatgcaccaggacatcatcagcctgtgggaccagagcctgaagccctgcgtgaagctgacccccctgtgcgtgaccctgcactgcagcaaccgcaccatcgactacaacaaccgcaccgacaacatgggcggcgagatcaagaactgcagcttccgatcgatcaactgcaacaccagcgccatcacccaggcctgccccaaggtgagcttcgaccccatccccatccactactgcgcccccgccggctacgccatcctgaagtgcaacaacaagaccttcaacggcaccggcccctgcaacaacgtgagcaccatccagtgcacccacggcaccaagcccgtggtgagcacccagctgctgctgaacggcagcctggccgaggaggagatcatcatccgcagcaagaacctgaccgacaacgtgaagaccatcatcgtgcacctgaacgagagcgtggagatcaactgcacccgccgatcggcccactgcaacatcagccgcaccgcctggaacaagaccctgcaggaggtgggcaagaagctggccgagcacttccccaacaaggccatcaagttcgccaagcacagcggcggcgacctggagatcaccacccacagcttcaactgccgcggcgagttcttctactgcaacacccgatcgatcccctgccgcatcaagcagatcatcaacatgtggcagggcgtgggccgcgccatgtacgccccccccatcgagggcatcctgacctgccgcagcaacatcaccggcctgctgctgacccgcgacggcggcaccggcatgcacgacaccgagatcttccgccccgagggcggcgacatgcgcgacaactggcgcagcgagctgtacaagtacaaggtggtggagatcaagcccctgggcatcgcccccaccaaggccaagcttaccgtgcaggtgcgccagctgctgagcggcatcgtgcagcagcagagcaacctgctgcgcgccatcgaggcccagcagcacatgctgcagctgaccgtgtggggcatcaagcagctgcagacccgcgtgctggccatcgagcgctacctgcgcgaccagcagctcgaggacatctggaacaacatgacctggatgcagtgggaccgcgagatcagcaactacaccaacaccatctaccgcctgctggaggacagccagaaccagcaggagaagaacgagcaggacctgctggccctggacaagtggcagaacctgtggacctggttcggcatcaccaactggctgtggtgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 108 - DNA, 6617 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtggagggcatccagcgcaactggaagcagtggtggatctggggcatcctgggcttctggatggtgatgatctacaacgtgcgcggcaacctgtgggtgaccgtgtactacggcgtgcccgtgtggaaggaggccaagaccaccctgttctgcgccagcgacgccaaggcctacgacgccgaggtgcacaacgtgtgggccacccacgcctgcgtgcccaccgaccccaacccccaggagatggtgctggagaacgtgaccgagaacttcaacatgtgggagaacgacatggtggagcagatgcaccaggacatcatcagcctgtgggaccagagcctgaagccctgcgtgaagctgacccccctgtgcgtgaccctgcactgcagcaaccgcaccatcgactacaacaaccgcaccgacaacatgggcggcgagatcaagaactgcagcttccgatcgatcaactgcaacaccagcgccatcacccaggcctgccccaaggtgagcttcgaccccatccccatccactactgcgcccccgccggctacgccatcctgaagtgcaacaacaagaccttcaacggcaccggcccctgcaacaacgtgagcaccatccagtgcacccacggcaccaagcccgtggtgagcacccagctgctgctgaacggcagcctggccgaggaggagatcatcatccgcagcaagaacctgaccgacaacgtgaagaccatcatcgtgcacctgaacgagagcgtggagatcaactgcacccgccccaacaacaacacccgcaagagcatccgcatcggccccggccaggccttctacgccaccggcgagatcatcggcgacatccgccaggcccactgcaacatcagccgcaccgcctggaacaagaccctgcaggaggtgggcaagaagctggccgagcacttccccaacaaggccatcaagttcgccaagcacagcggcggcgacctggagatcaccacccacagcttcaactgccgcggcgagttcttctactgcaacacccgatcgatcccctgccgcatcaagcagatcatcaacatgtggcagggcgtgggccgcgccatgtacgccccccccatcgagggcatcctgacctgccgcagcaacatcaccggcctgctgctgacccgcgacggcggcaccggcatgcacgacaccgagatcttccgccccgagggcggcgacatgcgcgacaactggcgcagcgagctgtacaagtacaaggtggtggagatcaagcccctgggcatcgcccccaccaaggccaagcttaccgtgcaggtgcgccagctgctgagcggcatcgtgcagcagcagagcaacctgctgcgcgccatcgaggcccagcagcacatgctgcagctgaccgtgtggggcatcaagcagctgcagacccgcgtgctggccatcgagcgctacctgcgcgaccagcagctcgaggacatctggaacaacatgacctggatgcagtgggaccgcgagatcagcaactacaccaacaccatctaccgcctgctggaggacagccagaaccagcaggagaagaacgagcaggacctgctggccctggacaagtggcagaacctgtggacctggttcggcatcaccaactggctgtggtgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 109 - DNA, 6713 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtggagggcatccagcgcaactggaagcagtggtggatctggggcatcctgggcttctggatggtgatgatctacaacgtgcgcggcaacctgtgggtgaccgtgtactacggcgtgcccgtgtggaaggaggccaagaccaccctgttctgcgccagcgacgccaaggcctacgacgccgaggtgcacaacgtgtgggccacccacgcctgcgtgcccaccgaccccaacccccaggagatggtgctggagaacgtgaccgagaacttcaacatgtgggagaacgacatggtggagcagatgcaccaggacatcatcagcctgtgggaccagagcctgaagccctgcgtgaagctgacccccctgtgcgtgaccctgcactgcagcaaccgcaccatcgactacaacaaccgcaccgacaacatgggcggcgagatcaagaactgcagcttcaacatgaccaccgaggtgcgcgacaagcgcgagaaggtgcacgccctgttctaccgcctggacatcgtgcccctgaagaacgagagcagcaacaccagcggcgactaccgcctgatcaactgcaacaccagcgccatcacccaggcctgccccaaggtgagcttcgaccccatccccatccactactgcgcccccgccggctacgccatcctgaagtgcaacaacaagaccttcaacggcaccggcccctgcaacaacgtgagcaccatccagtgcacccacggcaccaagcccgtggtgagcacccagctgctgctgaacggcagcctggccgaggaggagatcatcatccgcagcaagaacctgaccgacaacgtgaagaccatcatcgtgcacctgaacgagagcgtggagatcaactgcacccgccgatcggcccactgcaacatcagccgcaccgcctggaacaagaccctgcaggaggtgggcaagaagctggccgagcacttccccaacaaggccatcaagttcgccaagcacagcggcggcgacctggagatcaccacccacagcttcaactgccgcggcgagttcttctactgcaacaccagcagcctgttcaacagcacctacacccccaacagcaccgagaacatcaccggcaccgagaacagcatcatcaccatcccctgccgcatcaagcagatcatcaacatgtggcagggcgtgggccgcgccatgtacgccccccccatcgagggcatcctgacctgccgcagcaacatcaccggcctgctgctgacccgcgacggcggcaccggcatgcacgacaccgagatcttccgccccgagggcggcgacatgcgcgacaactggcgcagcgagctgtacaagtacaaggtggtggagatcaagcccctgggcatcgcccccaccaaggccaagcttaccgtgcaggtgcgccagctgctgagcggcatcgtgcagcagcagagcaacctgctgcgcgccatcgaggcccagcagcacatgctgcagctgaccgtgtggggcatcaagcagctgcagacccgcgtgctggccatcgagcgctacctgcgcgaccagcagctcgaggacatctggaacaacatgacctggatgcagtgggaccgcgagatcagcaactacaccaacaccatctaccgcctgctggaggacagccagaaccagcaggagaagaacgagcaggacctgctggccctggacaagtggcagaacctgtggacctggttcggcatcaccaactggctgtggtgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 110 - DNA, 6644 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtggagggcatccagcgcaactggaagcagtggtggatctggggcatcctgggcttctggatggtgatgatctacaacgtgcgcggcaacctgtgggtgaccgtgtactacggcgtgcccgtgtggaaggaggccaagaccaccctgttctgcgccagcgacgccaaggcctacgacgccgaggtgcacaacgtgtgggccacccacgcctgcgtgcccaccgaccccaacccccaggagatggtgctggagaacgtgaccgagaacttcaacatgtgggagaacgacatggtggagcagatgcaccaggacatcatcagcctgtgggaccagagcctgaagccctgcgtgaagctgacccccctgtgcgtgaccctgcactgcagcaaccgcaccatcgactacaacaaccgcaccgacaacatgggcggcgagatcaagaactgcagcttcaacatgaccaccgaggtgcgcgacaagcgcgagaaggtgcacgccctgttctaccgcctggacatcgtgcccctgaagaacgagagcagcaacaccagcggcgactaccgcctgatcaactgcaacaccagcgccatcacccaggcctgccccaaggtgagcttcgaccccatccccatccactactgcgcccccgccggctacgccatcctgaagtgcaacaacaagaccttcaacggcaccggcccctgcaacaacgtgagcaccatccagtgcacccacggcaccaagcccgtggtgagcacccagctgctgctgaacggcagcctggccgaggaggagatcatcatccgcagcaagaacctgaccgacaacgtgaagaccatcatcgtgcacctgaacgagagcgtggagatcaactgcacccgccgatcggcccactgcaacatcagccgcaccgcctggaacaagaccctgcaggaggtgggcaagaagctggccgagcacttccccaacaaggccatcaagttcgccaagcacagcggcggcgacctggagatcaccacccacagcttcaactgccgcggcgagttcttctactgcaacacccgatcgatcccctgccgcatcaagcagatcatcaacatgtggcagggcgtgggccgcgccatgtacgccccccccatcgagggcatcctgacctgccgcagcaacatcaccggcctgctgctgacccgcgacggcggcaccggcatgcacgacaccgagatcttccgccccgagggcggcgacatgcgcgacaactggcgcagcgagctgtacaagtacaaggtggtggagatcaagcccctgggcatcgcccccaccaaggccaagcttaccgtgcaggtgcgccagctgctgagcggcatcgtgcagcagcagagcaacctgctgcgcgccatcgaggcccagcagcacatgctgcagctgaccgtgtggggcatcaagcagctgcagacccgcgtgctggccatcgagcgctacctgcgcgaccagcagctcgaggacatctggaacaacatgacctggatgcagtgggaccgcgagatcagcaactacaccaacaccatctaccgcctgctggaggacagccagaaccagcaggagaagaacgagcaggacctgctggccctggacaagtggcagaacctgtggacctggttcggcatcaccaactggctgtggtgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 111 - DNA, 6725 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtggagggcatccagcgcaactggaagcagtggtggatctggggcatcctgggcttctggatggtgatgatctacaacgtgcgcggcaacctgtgggtgaccgtgtactacggcgtgcccgtgtggaaggaggccaagaccaccctgttctgcgccagcgacgccaaggcctacgacgccgaggtgcacaacgtgtgggccacccacgcctgcgtgcccaccgaccccaacccccaggagatggtgctggagaacgtgaccgagaacttcaacatgtgggagaacgacatggtggagcagatgcaccaggacatcatcagcctgtgggaccagagcctgaagccctgcgtgaagctgacccccctgtgcgtgaccctgcactgcagcaaccgcaccatcgactacaacaaccgcaccgacaacatgggcggcgagatcaagaactgcagcttcaacatgaccaccgaggtgcgcgacaagcgcgagaaggtgcacgccctgttctaccgcctggacatcgtgcccctgaagaacgagagcagcaacaccagcggcgactaccgcctgatcaactgcaacaccagcgccatcacccaggcctgccccaaggtgagcttcgaccccatccccatccactactgcgcccccgccggctacgccatcctgaagtgcaacaacaagaccttcaacggcaccggcccctgcaacaacgtgagcaccatccagtgcacccacggcaccaagcccgtggtgagcacccagctgctgctgaacggcagcctggccgaggaggagatcatcatccgcagcaagaacctgaccgacaacgtgaagaccatcatcgtgcacctgaacgagagcgtggagatcaactgcacccgccccaacaacaacacccgcaagagcatccgcatcggccccggccaggccttctacgccaccggcgagatcatcggcgacatccgccaggcccactgcaacatcagccgcaccgcctggaacaagaccctgcaggaggtgggcaagaagctggccgagcacttccccaacaaggccatcaagttcgccaagcacagcggcggcgacctggagatcaccacccacagcttcaactgccgcggcgagttcttctactgcaacacccgatcgatcccctgccgcatcaagcagatcatcaacatgtggcagggcgtgggccgcgccatgtacgccccccccatcgagggcatcctgacctgccgcagcaacatcaccggcctgctgctgacccgcgacggcggcaccggcatgcacgacaccgagatcttccgccccgagggcggcgacatgcgcgacaactggcgcagcgagctgtacaagtacaaggtggtggagatcaagcccctgggcatcgcccccaccaaggccaagcttaccgtgcaggtgcgccagctgctgagcggcatcgtgcagcagcagagcaacctgctgcgcgccatcgaggcccagcagcacatgctgcagctgaccgtgtggggcatcaagcagctgcagacccgcgtgctggccatcgagcgctacctgcgcgaccagcagctcgaggacatctggaacaacatgacctggatgcagtgggaccgcgagatcagcaactacaccaacaccatctaccgcctgctggaggacagccagaaccagcaggagaagaacgagcaggacctgctggccctggacaagtggcagaacctgtggacctggttcggcatcaccaactggctgtggtgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 112 - DNA, 6824 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtggagggcatccagcgcaactggaagcagtggtggatctggggcatcctgggcttctggatggtgatgatctacaacgtgcgcggcaacctgtgggtgaccgtgtactacggcgtgcccgtgtggaaggaggccaagaccaccctgttctgcgccagcgacgccaaggcctacgacgccgaggtgcacaacgtgtgggccacccacgcctgcgtgcccaccgaccccaacccccaggagatggtgctggagaacgtgaccgagaacttcaacatgtgggagaacgacatggtggagcagatgcaccaggacatcatcagcctgtgggaccagagcctgaagccctgcgtgaagctgacccccctgtgcgtgaccctgcactgcagcaaccgatcgaagaactgcagcttcaacatgaccaccgaggtgcgcgacaagcgcgagaaggtgcacgccctgttctaccgcctggacatcgtgcccctgaagaacgagagcagcaacaccagcggcgactaccgcctgatcaactgcaacaccagcgccatcacccaggcctgccccaaggtgagcttcgaccccatccccatccactactgcgcccccgccggctacgccatcctgaagtgcaacaacaagaccttcaacggcaccggcccctgcaacaacgtgagcaccatccagtgcacccacggcaccaagcccgtggtgagcacccagctgctgctgaacggcagcctggccgaggaggagatcatcatccgcagcaagaacctgaccgacaacgtgaagaccatcatcgtgcacctgaacgagagcgtggagatcaactgcacccgccccaacaacaacacccgcaagagcatccgcatcggccccggccaggccttctacgccaccggcgagatcatcggcgacatccgccaggcccactgcaacatcagccgcaccgcctggaacaagaccctgcaggaggtgggcaagaagctggccgagcacttccccaacaaggccatcaagttcgccaagcacagcggcggcgacctggagatcaccacccacagcttcaactgccgcggcgagttcttctactgcaacaccagcagcctgttcaacagcacctacacccccaacagcaccgagaacatcaccggcaccgagaacagcatcatcaccatcccctgccgcatcaagcagatcatcaacatgtggcagggcgtgggccgcgccatgtacgccccccccatcgagggcatcctgacctgccgcagcaacatcaccggcctgctgctgacccgcgacggcggcaccggcatgcacgacaccgagatcttccgccccgagggcggcgacatgcgcgacaactggcgcagcgagctgtacaagtacaaggtggtggagatcaagcccctgggcatcgcccccaccaaggccaagcttaccgtgcaggtgcgccagctgctgagcggcatcgtgcagcagcagagcaacctgctgcgcgccatcgaggcccagcagcacatgctgcagctgaccgtgtggggcatcaagcagctgcagacccgcgtgctggccatcgagcgctacctgcgcgaccagcagctcgaggacatctggaacaacatgacctggatgcagtgggaccgcgagatcagcaactacaccaacaccatctaccgcctgctggaggacagccagaaccagcaggagaagaacgagcaggacctgctggccctggacaagtggcagaacctgtggacctggttcggcatcaccaactggctgtggtacatcaagatcttcatcaagatcgtgggcggcctgatcggcctgcgcatcatcttcgccgtgctgagcatctgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 113 - DNA, 6695 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtggagggcatccagcgcaactggaagcagtggtggatctggggcatcctgggcttctggatggtgatgatctacaacgtgcgcggcaacctgtgggtgaccgtgtactacggcgtgcccgtgtggaaggaggccaagaccaccctgttctgcgccagcgacgccaaggcctacgacgccgaggtgcacaacgtgtgggccacccacgcctgcgtgcccaccgaccccaacccccaggagatggtgctggagaacgtgaccgagaacttcaacatgtgggagaacgacatggtggagcagatgcaccaggacatcatcagcctgtgggaccagagcctgaagccctgcgtgaagctgacccccctgtgcgtgaccctgcactgcagcaaccgatcgatcaactgcaacaccagcgccatcacccaggcctgccccaaggtgagcttcgaccccatccccatccactactgcgcccccgccggctacgccatcctgaagtgcaacaacaagaccttcaacggcaccggcccctgcaacaacgtgagcaccatccagtgcacccacggcaccaagcccgtggtgagcacccagctgctgctgaacggcagcctggccgaggaggagatcatcatccgcagcaagaacctgaccgacaacgtgaagaccatcatcgtgcacctgaacgagagcgtggagatcaactgcacccgccccaacaacaacacccgcaagagcatccgcatcggccccggccaggccttctacgccaccggcgagatcatcggcgacatccgccaggcccactgcaacatcagccgcaccgcctggaacaagaccctgcaggaggtgggcaagaagctggccgagcacttccccaacaaggccatcaagttcgccaagcacagcggcggcgacctggagatcaccacccacagcttcaactgccgcggcgagttcttctactgcaacaccagcagcctgttcaacagcacctacacccccaacagcaccgagaacatcaccggcaccgagaacagcatcatcaccatcccctgccgcatcaagcagatcatcaacatgtggcagggcgtgggccgcgccatgtacgccccccccatcgagggcatcctgacctgccgcagcaacatcaccggcctgctgctgacccgcgacggcggcaccggcatgcacgacaccgagatcttccgccccgagggcggcgacatgcgcgacaactggcgcagcgagctgtacaagtacaaggtggtggagatcaagcccctgggcatcgcccccaccaaggccaagcttaccgtgcaggtgcgccagctgctgagcggcatcgtgcagcagcagagcaacctgctgcgcgccatcgaggcccagcagcacatgctgcagctgaccgtgtggggcatcaagcagctgcagacccgcgtgctggccatcgagcgctacctgcgcgaccagcagctcgaggacatctggaacaacatgacctggatgcagtgggaccgcgagatcagcaactacaccaacaccatctaccgcctgctggaggacagccagaaccagcaggagaagaacgagcaggacctgctggccctggacaagtggcagaacctgtggacctggttcggcatcaccaactggctgtggtacatcaagatcttcatcaagatcgtgggcggcctgatcggcctgcgcatcatcttcgccgtgctgagcatctgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 114 - DNA, 6614 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtggagggcatccagcgcaactggaagcagtggtggatctggggcatcctgggcttctggatggtgatgatctacaacgtgcgcggcaacctgtgggtgaccgtgtactacggcgtgcccgtgtggaaggaggccaagaccaccctgttctgcgccagcgacgccaaggcctacgacgccgaggtgcacaacgtgtgggccacccacgcctgcgtgcccaccgaccccaacccccaggagatggtgctggagaacgtgaccgagaacttcaacatgtgggagaacgacatggtggagcagatgcaccaggacatcatcagcctgtgggaccagagcctgaagccctgcgtgaagctgacccccctgtgcgtgaccctgcactgcagcaaccgatcgatcaactgcaacaccagcgccatcacccaggcctgccccaaggtgagcttcgaccccatccccatccactactgcgcccccgccggctacgccatcctgaagtgcaacaacaagaccttcaacggcaccggcccctgcaacaacgtgagcaccatccagtgcacccacggcaccaagcccgtggtgagcacccagctgctgctgaacggcagcctggccgaggaggagatcatcatccgcagcaagaacctgaccgacaacgtgaagaccatcatcgtgcacctgaacgagagcgtggagatcaactgcacccgccgatcggcccactgcaacatcagccgcaccgcctggaacaagaccctgcaggaggtgggcaagaagctggccgagcacttccccaacaaggccatcaagttcgccaagcacagcggcggcgacctggagatcaccacccacagcttcaactgccgcggcgagttcttctactgcaacaccagcagcctgttcaacagcacctacacccccaacagcaccgagaacatcaccggcaccgagaacagcatcatcaccatcccctgccgcatcaagcagatcatcaacatgtggcagggcgtgggccgcgccatgtacgccccccccatcgagggcatcctgacctgccgcagcaacatcaccggcctgctgctgacccgcgacggcggcaccggcatgcacgacaccgagatcttccgccccgagggcggcgacatgcgcgacaactggcgcagcgagctgtacaagtacaaggtggtggagatcaagcccctgggcatcgcccccaccaaggccaagcttaccgtgcaggtgcgccagctgctgagcggcatcgtgcagcagcagagcaacctgctgcgcgccatcgaggcccagcagcacatgctgcagctgaccgtgtggggcatcaagcagctgcagacccgcgtgctggccatcgagcgctacctgcgcgaccagcagctcgaggacatctggaacaacatgacctggatgcagtgggaccgcgagatcagcaactacaccaacaccatctaccgcctgctggaggacagccagaaccagcaggagaagaacgagcaggacctgctggccctggacaagtggcagaacctgtggacctggttcggcatcaccaactggctgtggtacatcaagatcttcatcaagatcgtgggcggcctgatcggcctgcgcatcatcttcgccgtgctgagcatctgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 115 - DNA, 6545 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtggagggcatccagcgcaactggaagcagtggtggatctggggcatcctgggcttctggatggtgatgatctacaacgtgcgcggcaacctgtgggtgaccgtgtactacggcgtgcccgtgtggaaggaggccaagaccaccctgttctgcgccagcgacgccaaggcctacgacgccgaggtgcacaacgtgtgggccacccacgcctgcgtgcccaccgaccccaacccccaggagatggtgctggagaacgtgaccgagaacttcaacatgtgggagaacgacatggtggagcagatgcaccaggacatcatcagcctgtgggaccagagcctgaagccctgcgtgaagctgacccccctgtgcgtgaccctgcactgcagcaaccgatcgatcaactgcaacaccagcgccatcacccaggcctgccccaaggtgagcttcgaccccatccccatccactactgcgcccccgccggctacgccatcctgaagtgcaacaacaagaccttcaacggcaccggcccctgcaacaacgtgagcaccatccagtgcacccacggcaccaagcccgtggtgagcacccagctgctgctgaacggcagcctggccgaggaggagatcatcatccgcagcaagaacctgaccgacaacgtgaagaccatcatcgtgcacctgaacgagagcgtggagatcaactgcacccgccgatcggcccactgcaacatcagccgcaccgcctggaacaagaccctgcaggaggtgggcaagaagctggccgagcacttccccaacaaggccatcaagttcgccaagcacagcggcggcgacctggagatcaccacccacagcttcaactgccgcggcgagttcttctactgcaacacccgatcgatcccctgccgcatcaagcagatcatcaacatgtggcagggcgtgggccgcgccatgtacgccccccccatcgagggcatcctgacctgccgcagcaacatcaccggcctgctgctgacccgcgacggcggcaccggcatgcacgacaccgagatcttccgccccgagggcggcgacatgcgcgacaactggcgcagcgagctgtacaagtacaaggtggtggagatcaagcccctgggcatcgcccccaccaaggccaagcttaccgtgcaggtgcgccagctgctgagcggcatcgtgcagcagcagagcaacctgctgcgcgccatcgaggcccagcagcacatgctgcagctgaccgtgtggggcatcaagcagctgcagacccgcgtgctggccatcgagcgctacctgcgcgaccagcagctcgaggacatctggaacaacatgacctggatgcagtgggaccgcgagatcagcaactacaccaacaccatctaccgcctgctggaggacagccagaaccagcaggagaagaacgagcaggacctgctggccctggacaagtggcagaacctgtggacctggttcggcatcaccaactggctgtggtacatcaagatcttcatcaagatcgtgggcggcctgatcggcctgcgcatcatcttcgccgtgctgagcatctgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 116 - DNA, 6626 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtggagggcatccagcgcaactggaagcagtggtggatctggggcatcctgggcttctggatggtgatgatctacaacgtgcgcggcaacctgtgggtgaccgtgtactacggcgtgcccgtgtggaaggaggccaagaccaccctgttctgcgccagcgacgccaaggcctacgacgccgaggtgcacaacgtgtgggccacccacgcctgcgtgcccaccgaccccaacccccaggagatggtgctggagaacgtgaccgagaacttcaacatgtgggagaacgacatggtggagcagatgcaccaggacatcatcagcctgtgggaccagagcctgaagccctgcgtgaagctgacccccctgtgcgtgaccctgcactgcagcaaccgatcgatcaactgcaacaccagcgccatcacccaggcctgccccaaggtgagcttcgaccccatccccatccactactgcgcccccgccggctacgccatcctgaagtgcaacaacaagaccttcaacggcaccggcccctgcaacaacgtgagcaccatccagtgcacccacggcaccaagcccgtggtgagcacccagctgctgctgaacggcagcctggccgaggaggagatcatcatccgcagcaagaacctgaccgacaacgtgaagaccatcatcgtgcacctgaacgagagcgtggagatcaactgcacccgccccaacaacaacacccgcaagagcatccgcatcggccccggccaggccttctacgccaccggcgagatcatcggcgacatccgccaggcccactgcaacatcagccgcaccgcctggaacaagaccctgcaggaggtgggcaagaagctggccgagcacttccccaacaaggccatcaagttcgccaagcacagcggcggcgacctggagatcaccacccacagcttcaactgccgcggcgagttcttctactgcaacacccgatcgatcccctgccgcatcaagcagatcatcaacatgtggcagggcgtgggccgcgccatgtacgccccccccatcgagggcatcctgacctgccgcagcaacatcaccggcctgctgctgacccgcgacggcggcaccggcatgcacgacaccgagatcttccgccccgagggcggcgacatgcgcgacaactggcgcagcgagctgtacaagtacaaggtggtggagatcaagcccctgggcatcgcccccaccaaggccaagcttaccgtgcaggtgcgccagctgctgagcggcatcgtgcagcagcagagcaacctgctgcgcgccatcgaggcccagcagcacatgctgcagctgaccgtgtggggcatcaagcagctgcagacccgcgtgctggccatcgagcgctacctgcgcgaccagcagctcgaggacatctggaacaacatgacctggatgcagtgggaccgcgagatcagcaactacaccaacaccatctaccgcctgctggaggacagccagaaccagcaggagaagaacgagcaggacctgctggccctggacaagtggcagaacctgtggacctggttcggcatcaccaactggctgtggtacatcaagatcttcatcaagatcgtgggcggcctgatcggcctgcgcatcatcttcgccgtgctgagcatctgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 117 - DNA, 6743 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtggagggcatccagcgcaactggaagcagtggtggatctggggcatcctgggcttctggatggtgatgatctacaacgtgcgcggcaacctgtgggtgaccgtgtactacggcgtgcccgtgtggaaggaggccaagaccaccctgttctgcgccagcgacgccaaggcctacgacgccgaggtgcacaacgtgtgggccacccacgcctgcgtgcccaccgaccccaacccccaggagatggtgctggagaacgtgaccgagaacttcaacatgtgggagaacgacatggtggagcagatgcaccaggacatcatcagcctgtgggaccagagcctgaagccctgcgtgaagctgacccccctgtgcgtgaccctgcactgcagcaaccgatcgaagaactgcagcttcaacatgaccaccgaggtgcgcgacaagcgcgagaaggtgcacgccctgttctaccgcctggacatcgtgcccctgaagaacgagagcagcaacaccagcggcgactaccgcctgatcaactgcaacaccagcgccatcacccaggcctgccccaaggtgagcttcgaccccatccccatccactactgcgcccccgccggctacgccatcctgaagtgcaacaacaagaccttcaacggcaccggcccctgcaacaacgtgagcaccatccagtgcacccacggcaccaagcccgtggtgagcacccagctgctgctgaacggcagcctggccgaggaggagatcatcatccgcagcaagaacctgaccgacaacgtgaagaccatcatcgtgcacctgaacgagagcgtggagatcaactgcacccgccgatcggcccactgcaacatcagccgcaccgcctggaacaagaccctgcaggaggtgggcaagaagctggccgagcacttccccaacaaggccatcaagttcgccaagcacagcggcggcgacctggagatcaccacccacagcttcaactgccgcggcgagttcttctactgcaacaccagcagcctgttcaacagcacctacacccccaacagcaccgagaacatcaccggcaccgagaacagcatcatcaccatcccctgccgcatcaagcagatcatcaacatgtggcagggcgtgggccgcgccatgtacgccccccccatcgagggcatcctgacctgccgcagcaacatcaccggcctgctgctgacccgcgacggcggcaccggcatgcacgacaccgagatcttccgccccgagggcggcgacatgcgcgacaactggcgcagcgagctgtacaagtacaaggtggtggagatcaagcccctgggcatcgcccccaccaaggccaagcttaccgtgcaggtgcgccagctgctgagcggcatcgtgcagcagcagagcaacctgctgcgcgccatcgaggcccagcagcacatgctgcagctgaccgtgtggggcatcaagcagctgcagacccgcgtgctggccatcgagcgctacctgcgcgaccagcagctcgaggacatctggaacaacatgacctggatgcagtgggaccgcgagatcagcaactacaccaacaccatctaccgcctgctggaggacagccagaaccagcaggagaagaacgagcaggacctgctggccctggacaagtggcagaacctgtggacctggttcggcatcaccaactggctgtggtacatcaagatcttcatcaagatcgtgggcggcctgatcggcctgcgcatcatcttcgccgtgctgagcatctgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 118 - DNA, 6674 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtggagggcatccagcgcaactggaagcagtggtggatctggggcatcctgggcttctggatggtgatgatctacaacgtgcgcggcaacctgtgggtgaccgtgtactacggcgtgcccgtgtggaaggaggccaagaccaccctgttctgcgccagcgacgccaaggcctacgacgccgaggtgcacaacgtgtgggccacccacgcctgcgtgcccaccgaccccaacccccaggagatggtgctggagaacgtgaccgagaacttcaacatgtgggagaacgacatggtggagcagatgcaccaggacatcatcagcctgtgggaccagagcctgaagccctgcgtgaagctgacccccctgtgcgtgaccctgcactgcagcaaccgatcgaagaactgcagcttcaacatgaccaccgaggtgcgcgacaagcgcgagaaggtgcacgccctgttctaccgcctggacatcgtgcccctgaagaacgagagcagcaacaccagcggcgactaccgcctgatcaactgcaacaccagcgccatcacccaggcctgccccaaggtgagcttcgaccccatccccatccactactgcgcccccgccggctacgccatcctgaagtgcaacaacaagaccttcaacggcaccggcccctgcaacaacgtgagcaccatccagtgcacccacggcaccaagcccgtggtgagcacccagctgctgctgaacggcagcctggccgaggaggagatcatcatccgcagcaagaacctgaccgacaacgtgaagaccatcatcgtgcacctgaacgagagcgtggagatcaactgcacccgccgatcggcccactgcaacatcagccgcaccgcctggaacaagaccctgcaggaggtgggcaagaagctggccgagcacttccccaacaaggccatcaagttcgccaagcacagcggcggcgacctggagatcaccacccacagcttcaactgccgcggcgagttcttctactgcaacacccgatcgatcccctgccgcatcaagcagatcatcaacatgtggcagggcgtgggccgcgccatgtacgccccccccatcgagggcatcctgacctgccgcagcaacatcaccggcctgctgctgacccgcgacggcggcaccggcatgcacgacaccgagatcttccgccccgagggcggcgacatgcgcgacaactggcgcagcgagctgtacaagtacaaggtggtggagatcaagcccctgggcatcgcccccaccaaggccaagcttaccgtgcaggtgcgccagctgctgagcggcatcgtgcagcagcagagcaacctgctgcgcgccatcgaggcccagcagcacatgctgcagctgaccgtgtggggcatcaagcagctgcagacccgcgtgctggccatcgagcgctacctgcgcgaccagcagctcgaggacatctggaacaacatgacctggatgcagtgggaccgcgagatcagcaactacaccaacaccatctaccgcctgctggaggacagccagaaccagcaggagaagaacgagcaggacctgctggccctggacaagtggcagaacctgtggacctggttcggcatcaccaactggctgtggtacatcaagatcttcatcaagatcgtgggcggcctgatcggcctgcgcatcatcttcgccgtgctgagcatctgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 119 - DNA, 6755 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtggagggcatccagcgcaactggaagcagtggtggatctggggcatcctgggcttctggatggtgatgatctacaacgtgcgcggcaacctgtgggtgaccgtgtactacggcgtgcccgtgtggaaggaggccaagaccaccctgttctgcgccagcgacgccaaggcctacgacgccgaggtgcacaacgtgtgggccacccacgcctgcgtgcccaccgaccccaacccccaggagatggtgctggagaacgtgaccgagaacttcaacatgtgggagaacgacatggtggagcagatgcaccaggacatcatcagcctgtgggaccagagcctgaagccctgcgtgaagctgacccccctgtgcgtgaccctgcactgcagcaaccgatcgaagaactgcagcttcaacatgaccaccgaggtgcgcgacaagcgcgagaaggtgcacgccctgttctaccgcctggacatcgtgcccctgaagaacgagagcagcaacaccagcggcgactaccgcctgatcaactgcaacaccagcgccatcacccaggcctgccccaaggtgagcttcgaccccatccccatccactactgcgcccccgccggctacgccatcctgaagtgcaacaacaagaccttcaacggcaccggcccctgcaacaacgtgagcaccatccagtgcacccacggcaccaagcccgtggtgagcacccagctgctgctgaacggcagcctggccgaggaggagatcatcatccgcagcaagaacctgaccgacaacgtgaagaccatcatcgtgcacctgaacgagagcgtggagatcaactgcacccgccccaacaacaacacccgcaagagcatccgcatcggccccggccaggccttctacgccaccggcgagatcatcggcgacatccgccaggcccactgcaacatcagccgcaccgcctggaacaagaccctgcaggaggtgggcaagaagctggccgagcacttccccaacaaggccatcaagttcgccaagcacagcggcggcgacctggagatcaccacccacagcttcaactgccgcggcgagttcttctactgcaacacccgatcgatcccctgccgcatcaagcagatcatcaacatgtggcagggcgtgggccgcgccatgtacgccccccccatcgagggcatcctgacctgccgcagcaacatcaccggcctgctgctgacccgcgacggcggcaccggcatgcacgacaccgagatcttccgccccgagggcggcgacatgcgcgacaactggcgcagcgagctgtacaagtacaaggtggtggagatcaagcccctgggcatcgcccccaccaaggccaagcttaccgtgcaggtgcgccagctgctgagcggcatcgtgcagcagcagagcaacctgctgcgcgccatcgaggcccagcagcacatgctgcagctgaccgtgtggggcatcaagcagctgcagacccgcgtgctggccatcgagcgctacctgcgcgaccagcagctcgaggacatctggaacaacatgacctggatgcagtgggaccgcgagatcagcaactacaccaacaccatctaccgcctgctggaggacagccagaaccagcaggagaagaacgagcaggacctgctggccctggacaagtggcagaacctgtggacctggttcggcatcaccaactggctgtggtacatcaagatcttcatcaagatcgtgggcggcctgatcggcctgcgcatcatcttcgccgtgctgagcatctgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 120 - DNA, 6677 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtggagggcatccagcgcaactggaagcagtggtggatctggggcatcctgggcttctggatggtgatgatctacaacgtgcgcggcaacctgtgggtgaccgtgtactacggcgtgcccgtgtggaaggaggccaagaccaccctgttctgcgccagcgacgccaaggcctacgacgccgaggtgcacaacgtgtgggccacccacgcctgcgtgcccaccgaccccaacccccaggagatggtgctggagaacgtgaccgagaacttcaacatgtgggagaacgacatggtggagcagatgcaccaggacatcatcagcctgtgggaccagagcctgaagccctgcgtgaagctgacccccctgtgcgtgaccctgcactgcagcaaccgcaccatcgactacaacaaccgcaccgacaacatgggcggcgagatcaagaactgcagcttccgatcgatcaactgcaacaccagcgccatcacccaggcctgccccaaggtgagcttcgaccccatccccatccactactgcgcccccgccggctacgccatcctgaagtgcaacaacaagaccttcaacggcaccggcccctgcaacaacgtgagcaccatccagtgcacccacggcaccaagcccgtggtgagcacccagctgctgctgaacggcagcctggccgaggaggagatcatcatccgcagcaagaacctgaccgacaacgtgaagaccatcatcgtgcacctgaacgagagcgtggagatcaactgcacccgccgatcggcccactgcaacatcagccgcaccgcctggaacaagaccctgcaggaggtgggcaagaagctggccgagcacttccccaacaaggccatcaagttcgccaagcacagcggcggcgacctggagatcaccacccacagcttcaactgccgcggcgagttcttctactgcaacaccagcagcctgttcaacagcacctacacccccaacagcaccgagaacatcaccggcaccgagaacagcatcatcaccatcccctgccgcatcaagcagatcatcaacatgtggcagggcgtgggccgcgccatgtacgccccccccatcgagggcatcctgacctgccgcagcaacatcaccggcctgctgctgacccgcgacggcggcaccggcatgcacgacaccgagatcttccgccccgagggcggcgacatgcgcgacaactggcgcagcgagctgtacaagtacaaggtggtggagatcaagcccctgggcatcgcccccaccaaggccaagcttaccgtgcaggtgcgccagctgctgagcggcatcgtgcagcagcagagcaacctgctgcgcgccatcgaggcccagcagcacatgctgcagctgaccgtgtggggcatcaagcagctgcagacccgcgtgctggccatcgagcgctacctgcgcgaccagcagctcgaggacatctggaacaacatgacctggatgcagtgggaccgcgagatcagcaactacaccaacaccatctaccgcctgctggaggacagccagaaccagcaggagaagaacgagcaggacctgctggccctggacaagtggcagaacctgtggacctggttcggcatcaccaactggctgtggtacatcaagatcttcatcaagatcgtgggcggcctgatcggcctgcgcatcatcttcgccgtgctgagcatctgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 121 - DNA, 6677 bp, Artificial Sequence; identical to SEQ ID NO: 120
  plasmid pVR1012x/s containing HIV genes

SEQ ID NO: 122 - DNA, 6608 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtggagggcatccagcgcaactggaagcagtggtggatctggggcatcctgggcttctggatggtgatgatctacaacgtgcgcggcaacctgtgggtgaccgtgtactacggcgtgcccgtgtggaaggaggccaagaccaccctgttctgcgccagcgacgccaaggcctacgacgccgaggtgcacaacgtgtgggccacccacgcctgcgtgcccaccgaccccaacccccaggagatggtgctggagaacgtgaccgagaacttcaacatgtgggagaacgacatggtggagcagatgcaccaggacatcatcagcctgtgggaccagagcctgaagccctgcgtgaagctgacccccctgtgcgtgaccctgcactgcagcaaccgcaccatcgactacaacaaccgcaccgacaacatgggcggcgagatcaagaactgcagcttccgatcgatcaactgcaacaccagcgccatcacccaggcctgccccaaggtgagcttcgaccccatccccatccactactgcgcccccgccggctacgccatcctgaagtgcaacaacaagaccttcaacggcaccggcccctgcaacaacgtgagcaccatccagtgcacccacggcaccaagcccgtggtgagcacccagctgctgctgaacggcagcctggccgaggaggagatcatcatccgcagcaagaacctgaccgacaacgtgaagaccatcatcgtgcacctgaacgagagcgtggagatcaactgcacccgccgatcggcccactgcaacatcagccgcaccgcctggaacaagaccctgcaggaggtgggcaagaagctggccgagcacttccccaacaaggccatcaagttcgccaagcacagcggcggcgacctggagatcaccacccacagcttcaactgccgcggcgagttcttctactgcaacacccgatcgatcccctgccgcatcaagcagatcatcaacatgtggcagggcgtgggccgcgccatgtacgccccccccatcgagggcatcctgacctgccgcagcaacatcaccggcctgctgctgacccgcgacggcggcaccggcatgcacgacaccgagatcttccgccccgagggcggcgacatgcgcgacaactggcgcagcgagctgtacaagtacaaggtggtggagatcaagcccctgggcatcgcccccaccaaggccaagcttaccgtgcaggtgcgccagctgctgagcggcatcgtgcagcagcagagcaacctgctgcgcgccatcgaggcccagcagcacatgctgcagctgaccgtgtggggcatcaagcagctgcagacccgcgtgctggccatcgagcgctacctgcgcgaccagcagctcgaggacatctggaacaacatgacctggatgcagtgggaccgcgagatcagcaactacaccaacaccatctaccgcctgctggaggacagccagaaccagcaggagaagaacgagcaggacctgctggccctggacaagtggcagaacctgtggacctggttcggcatcaccaactggctgtggtacatcaagatcttcatcaagatcgtgggcggcctgatcggcctgcgcatcatcttcgccgtgctgagcatctgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 123 - DNA, 6689 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtggagggcatccagcgcaactggaagcagtggtggatctggggcatcctgggcttctggatggtgatgatctacaacgtgcgcggcaacctgtgggtgaccgtgtactacggcgtgcccgtgtggaaggaggccaagaccaccctgttctgcgccagcgacgccaaggcctacgacgccgaggtgcacaacgtgtgggccacccacgcctgcgtgcccaccgaccccaacccccaggagatggtgctggagaacgtgaccgagaacttcaacatgtgggagaacgacatggtggagcagatgcaccaggacatcatcagcctgtgggaccagagcctgaagccctgcgtgaagctgacccccctgtgcgtgaccctgcactgcagcaaccgcaccatcgactacaacaaccgcaccgacaacatgggcggcgagatcaagaactgcagcttccgatcgatcaactgcaacaccagcgccatcacccaggcctgccccaaggtgagcttcgaccccatccccatccactactgcgcccccgccggctacgccatcctgaagtgcaacaacaagaccttcaacggcaccggcccctgcaacaacgtgagcaccatccagtgcacccacggcaccaagcccgtggtgagcacccagctgctgctgaacggcagcctggccgaggaggagatcatcatccgcagcaagaacctgaccgacaacgtgaagaccatcatcgtgcacctgaacgagagcgtggagatcaactgcacccgccccaacaacaacacccgcaagagcatccgcatcggccccggccaggccttctacgccaccggcgagatcatcggcgacatccgccaggcccactgcaacatcagccgcaccgcctggaacaagaccctgcaggaggtgggcaagaagctggccgagcacttccccaacaaggccatcaagttcgccaagcacagcggcggcgacctggagatcaccacccacagcttcaactgccgcggcgagttcttctactgcaacacccgatcgatcccctgccgcatcaagcagatcatcaacatgtggcagggcgtgggccgcgccatgtacgccccccccatcgagggcatcctgacctgccgcagcaacatcaccggcctgctgctgacccgcgacggcggcaccggcatgcacgacaccgagatcttccgccccgagggcggcgacatgcgcgacaactggcgcagcgagctgtacaagtacaaggtggtggagatcaagcccctgggcatcgcccccaccaaggccaagcttaccgtgcaggtgcgccagctgctgagcggcatcgtgcagcagcagagcaacctgctgcgcgccatcgaggcccagcagcacatgctgcagctgaccgtgtggggcatcaagcagctgcagacccgcgtgctggccatcgagcgctacctgcgcgaccagcagctcgaggacatctggaacaacatgacctggatgcagtgggaccgcgagatcagcaactacaccaacaccatctaccgcctgctggaggacagccagaaccagcaggagaagaacgagcaggacctgctggccctggacaagtggcagaacctgtggacctggttcggcatcaccaactggctgtggtacatcaagatcttcatcaagatcgtgggcggcctgatcggcctgcgcatcatcttcgccgtgctgagcatctgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 124 - DNA, 6785 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtggagggcatccagcgcaactggaagcagtggtggatctggggcatcctgggcttctggatggtgatgatctacaacgtgcgcggcaacctgtgggtgaccgtgtactacggcgtgcccgtgtggaaggaggccaagaccaccctgttctgcgccagcgacgccaaggcctacgacgccgaggtgcacaacgtgtgggccacccacgcctgcgtgcccaccgaccccaacccccaggagatggtgctggagaacgtgaccgagaacttcaacatgtgggagaacgacatggtggagcagatgcaccaggacatcatcagcctgtgggaccagagcctgaagccctgcgtgaagctgacccccctgtgcgtgaccctgcactgcagcaaccgcaccatcgactacaacaaccgcaccgacaacatgggcggcgagatcaagaactgcagcttcaacatgaccaccgaggtgcgcgacaagcgcgagaaggtgcacgccctgttctaccgcctggacatcgtgcccctgaagaacgagagcagcaacaccagcggcgactaccgcctgatcaactgcaacaccagcgccatcacccaggcctgccccaaggtgagcttcgaccccatccccatccactactgcgcccccgccggctacgccatcctgaagtgcaacaacaagaccttcaacggcaccggcccctgcaacaacgtgagcaccatccagtgcacccacggcaccaagcccgtggtgagcacccagctgctgctgaacggcagcctggccgaggaggagatcatcatccgcagcaagaacctgaccgacaacgtgaagaccatcatcgtgcacctgaacgagagcgtggagatcaactgcacccgccgatcggcccactgcaacatcagccgcaccgcctggaacaagaccctgcaggaggtgggcaagaagctggccgagcacttccccaacaaggccatcaagttcgccaagcacagcggcggcgacctggagatcaccacccacagcttcaactgccgcggcgagttcttctactgcaacaccagcagcctgttcaacagcacctacacccccaacagcaccgagaacatcaccggcaccgagaacagcatcatcaccatcccctgccgcatcaagcagatcatcaacatgtggcagggcgtgggccgcgccatgtacgccccccccatcgagggcatcctgacctgccgcagcaacatcaccggcctgctgctgacccgcgacggcggcaccggcatgcacgacaccgagatcttccgccccgagggcggcgacatgcgcgacaactggcgcagcgagctgtacaagtacaaggtggtggagatcaagcccctgggcatcgcccccaccaaggccaagcttaccgtgcaggtgcgccagctgctgagcggcatcgtgcagcagcagagcaacctgctgcgcgccatcgaggcccagcagcacatgctgcagctgaccgtgtggggcatcaagcagctgcagacccgcgtgctggccatcgagcgctacctgcgcgaccagcagctcgaggacatctggaacaacatgacctggatgcagtgggaccgcgagatcagcaactacaccaacaccatctaccgcctgctggaggacagccagaaccagcaggagaagaacgagcaggacctgctggccctggacaagtggcagaacctgtggacctggttcggcatcaccaactggctgtggtacatcaagatcttcatcaagatcgtgggcggcctgatcggcctgcgcatcatcttcgccgtgctgagcatctgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 125 - DNA, 6716 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtggagggcatccagcgcaactggaagcagtggtggatctggggcatcctgggcttctggatggtgatgatctacaacgtgcgcggcaacctgtgggtgaccgtgtactacggcgtgcccgtgtggaaggaggccaagaccaccctgttctgcgccagcgacgccaaggcctacgacgccgaggtgcacaacgtgtgggccacccacgcctgcgtgcccaccgaccccaacccccaggagatggtgctggagaacgtgaccgagaacttcaacatgtgggagaacgacatggtggagcagatgcaccaggacatcatcagcctgtgggaccagagcctgaagccctgcgtgaagctgacccccctgtgcgtgaccctgcactgcagcaaccgcaccatcgactacaacaaccgcaccgacaacatgggcggcgagatcaagaactgcagcttcaacatgaccaccgaggtgcgcgacaagcgcgagaaggtgcacgccctgttctaccgcctggacatcgtgcccctgaagaacgagagcagcaacaccagcggcgactaccgcctgatcaactgcaacaccagcgccatcacccaggcctgccccaaggtgagcttcgaccccatccccatccactactgcgcccccgccggctacgccatcctgaagtgcaacaacaagaccttcaacggcaccggcccctgcaacaacgtgagcaccatccagtgcacccacggcaccaagcccgtggtgagcacccagctgctgctgaacggcagcctggccgaggaggagatcatcatccgcagcaagaacctgaccgacaacgtgaagaccatcatcgtgcacctgaacgagagcgtggagatcaactgcacccgccgatcggcccactgcaacatcagccgcaccgcctggaacaagaccctgcaggaggtgggcaagaagctggccgagcacttccccaacaaggccatcaagttcgccaagcacagcggcggcgacctggagatcaccacccacagcttcaactgccgcggcgagttcttctactgcaacacccgatcgatcccctgccgcatcaagcagatcatcaacatgtggcagggcgtgggccgcgccatgtacgccccccccatcgagggcatcctgacctgccgcagcaacatcaccggcctgctgctgacccgcgacggcggcaccggcatgcacgacaccgagatcttccgccccgagggcggcgacatgcgcgacaactggcgcagcgagctgtacaagtacaaggtggtggagatcaagcccctgggcatcgcccccaccaaggccaagcttaccgtgcaggtgcgccagctgctgagcggcatcgtgcagcagcagagcaacctgctgcgcgccatcgaggcccagcagcacatgctgcagctgaccgtgtggggcatcaagcagctgcagacccgcgtgctggccatcgagcgctacctgcgcgaccagcagctcgaggacatctggaacaacatgacctggatgcagtgggaccgcgagatcagcaactacaccaacaccatctaccgcctgctggaggacagccagaaccagcaggagaagaacgagcaggacctgctggccctggacaagtggcagaacctgtggacctggttcggcatcaccaactggctgtggtacatcaagatcttcatcaagatcgtgggcggcctgatcggcctgcgcatcatcttcgccgtgctgagcatctgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 126 - DNA, 6797 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtggagggcatccagcgcaactggaagcagtggtggatctggggcatcctgggcttctggatggtgatgatctacaacgtgcgcggcaacctgtgggtgaccgtgtactacggcgtgcccgtgtggaaggaggccaagaccaccctgttctgcgccagcgacgccaaggcctacgacgccgaggtgcacaacgtgtgggccacccacgcctgcgtgcccaccgaccccaacccccaggagatggtgctggagaacgtgaccgagaacttcaacatgtgggagaacgacatggtggagcagatgcaccaggacatcatcagcctgtgggaccagagcctgaagccctgcgtgaagctgacccccctgtgcgtgaccctgcactgcagcaaccgcaccatcgactacaacaaccgcaccgacaacatgggcggcgagatcaagaactgcagcttcaacatgaccaccgaggtgcgcgacaagcgcgagaaggtgcacgccctgttctaccgcctggacatcgtgcccctgaagaacgagagcagcaacaccagcggcgactaccgcctgatcaactgcaacaccagcgccatcacccaggcctgccccaaggtgagcttcgaccccatccccatccactactgcgcccccgccggctacgccatcctgaagtgcaacaacaagaccttcaacggcaccggcccctgcaacaacgtgagcaccatccagtgcacccacggcaccaagcccgtggtgagcacccagctgctgctgaacggcagcctggccgaggaggagatcatcatccgcagcaagaacctgaccgacaacgtgaagaccatcatcgtgcacctgaacgagagcgtggagatcaactgcacccgccccaacaacaacacccgcaagagcatccgcatcggccccggccaggccttctacgccaccggcgagatcatcggcgacatccgccaggcccactgcaacatcagccgcaccgcctggaacaagaccctgcaggaggtgggcaagaagctggccgagcacttccccaacaaggccatcaagttcgccaagcacagcggcggcgacctggagatcaccacccacagcttcaactgccgcggcgagttcttctactgcaacacccgatcgatcccctgccgcatcaagcagatcatcaacatgtggcagggcgtgggccgcgccatgtacgccccccccatcgagggcatcctgacctgccgcagcaacatcaccggcctgctgctgacccgcgacggcggcaccggcatgcacgacaccgagatcttccgccccgagggcggcgacatgcgcgacaactggcgcagcgagctgtacaagtacaaggtggtggagatcaagcccctgggcatcgcccccaccaaggccaagcttaccgtgcaggtgcgccagctgctgagcggcatcgtgcagcagcagagcaacctgctgcgcgccatcgaggcccagcagcacatgctgcagctgaccgtgtggggcatcaagcagctgcagacccgcgtgctggccatcgagcgctacctgcgcgaccagcagctcgaggacatctggaacaacatgacctggatgcagtgggaccgcgagatcagcaactacaccaacaccatctaccgcctgctggaggacagccagaaccagcaggagaagaacgagcaggacctgctggccctggacaagtggcagaacctgtggacctggttcggcatcaccaactggctgtggtacatcaagatcttcatcaagatcgtgggcggcctgatcggcctgcgcatcatcttcgccgtgctgagcatctgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 127 - DNA, 6718 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctagccgtaactgctccttcaacaccaccaccgaaatccgtgacaaaaaacagcagggttacgctctgttctaccgtccggacatcgttctgctgaaagaaaaccgtaacaactccaacaactccgaatacatcctgatcaactgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtccgaacaacaacacccgtaaatccatgcgtatcggtccgggtcagaccttctacgctaccggtgacatcatcggtgacatccgtcaggcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccacccgtctgttcaacaacaacgctaccgaagacgaaaccatcaccctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 128 - DNA, 6586 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctagcatcaactgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtccgaacaacaacacccgtaaatccatgcgtatcggtccgggtcagaccttctacgctaccggtgacatcatcggtgacatccgtcaggcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccacccgtctgttcaacaacaacgctaccgaagacgaaaccatcaccctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 129 - DNA, 6505 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctagcatcaactgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtgctagcgcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccacccgtctgttcaacaacaacgctaccgaagacgaaaccatcaccctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 130 - DNA, 6466 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctagcatcaactgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtgctagcgcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccgctagcctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 131 - DNA, 6547 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctagcatcaactgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtccgaacaacaacacccgtaaatccatgcgtatcggtccgggtcagaccttctacgctaccggtgacatcatcggtgacatccgtcaggcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccgctagcctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 132 - DNA, 6637 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctagccgtaactgctccttcaacaccaccaccgaaatccgtgacaaaaaacagcagggttacgctctgttctaccgtccggacatcgttctgctgaaagaaaaccgtaacaactccaacaactccgaatacatcctgatcaactgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtgctagcgcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccacccgtctgttcaacaacaacgctaccgaagacgaaaccatcaccctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 133 - DNA, 6598 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctagccgtaactgctccttcaacaccaccaccgaaatccgtgacaaaaaacagcagggttacgctctgttctaccgtccggacatcgttctgctgaaagaaaaccgtaacaactccaacaactccgaatacatcctgatcaactgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtgctagcgcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccgctagcctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 134 - DNA, 6679 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctagccgtaactgctccttcaacaccaccaccgaaatccgtgacaaaaaacagcagggttacgctctgttctaccgtccggacatcgttctgctgaaagaaaaccgtaacaactccaacaactccgaatacatcctgatcaactgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtccgaacaacaacacccgtaaatccatgcgtatcggtccgggtcagaccttctacgctaccggtgacatcatcggtgacatccgtcaggcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccgctagcctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 135 - DNA, 6646 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctaccttcaaaaacaacgttaccaacgacatgaacaaagaaatccgtaactgctccttcgcatgcatcaactgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtccgaacaacaacacccgtaaatccatgcgtatcggtccgggtcagaccttctacgctaccggtgacatcatcggtgacatccgtcaggcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccacccgtctgttcaacaacaacgctaccgaagacgaaaccatcaccctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 136 - DNA, 6565 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctaccttcaaaaacaacgttaccaacgacatgaacaaagaaatccgtaactgctccttcgcatgcatcaactgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtgctagcgcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccacccgtctgttcaacaacaacgctaccgaagacgaaaccatcaccctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 137 - DNA, 6526 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctaccttcaaaaacaacgttaccaacgacatgaacaaagaaatccgtaactgctccttcgcatgcatcaactgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtgctagcgcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccgctagcctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 138 - DNA, 6607 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctaccttcaaaaacaacgttaccaacgacatgaacaaagaaatccgtaactgctccttcgcatgcatcaactgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtccgaacaacaacacccgtaaatccatgcgtatcggtccgggtcagaccttctacgctaccggtgacatcatcggtgacatccgtcaggcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccgctagcctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 139 - DNA, 6676 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctaccttcaaaaacaacgttaccaacgacatgaacaaagaaatccgtaactgctccttcaacaccaccaccgaaatccgtgacaaaaaacagcagggttacgctctgttctaccgtccggacatcgttctgctgaaagaaaaccgtaacaactccaacaactccgaatacatcctgatcaactgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtgctagcgcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccacccgtctgttcaacaacaacgctaccgaagacgaaaccatcaccctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 140 - DNA, 6637 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctaccttcaaaaacaacgttaccaacgacatgaacaaagaaatccgtaactgctccttcaacaccaccaccgaaatccgtgacaaaaaacagcagggttacgctctgttctaccgtccggacatcgttctgctgaaagaaaaccgtaacaactccaacaactccgaatacatcctgatcaactgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtgctagcgcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccgctagcctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 141 - DNA, 6718 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctaccttcaaaaacaacgttaccaacgacatgaacaaagaaatccgtaactgctccttcaacaccaccaccgaaatccgtgacaaaaaacagcagggttacgctctgttctaccgtccggacatcgttctgctgaaagaaaaccgtaacaactccaacaactccgaatacatcctgatcaactgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtccgaacaacaacacccgtaaatccatgcgtatcggtccgggtcagaccttctacgctaccggtgacatcatcggtgacatccgtcaggcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccgctagcctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 142 - DNA, 6790 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctagccgtaactgctccttcaacaccaccaccgaaatccgtgacaaaaaacagcagggttacgctctgttctaccgtccggacatcgttctgctgaaagaaaaccgtaacaactccaacaactccgaatacatcctgatcaactgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtccgaacaacaacacccgtaaatccatgcgtatcggtccgggtcagaccttctacgctaccggtgacatcatcggtgacatccgtcaggcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccacccgtctgttcaacaacaacgctaccgaagacgaaaccatcaccctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtacatcaaaatcttcatcatgatcgttggtggtctgatcggtctgcgtatcatcttcgctgttctgtccatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 143 - DNA, 6658 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctagcatcaactgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtccgaacaacaacacccgtaaatccatgcgtatcggtccgggtcagaccttctacgctaccggtgacatcatcggtgacatccgtcaggcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccacccgtctgttcaacaacaacgctaccgaagacgaaaccatcaccctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtacatcaaaatcttcatcatgatcgttggtggtctgatcggtctgcgtatcatcttcgctgttctgtccatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 144 - DNA, 6577 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctagcatcaactgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtgctagcgcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccacccgtctgttcaacaacaacgctaccgaagacgaaaccatcaccctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtacatcaaaatcttcatcatgatcgttggtggtctgatcggtctgcgtatcatcttcgctgttctgtccatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 145 - DNA, 6538 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctagcatcaactgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtgctagcgcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccgctagcctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtacatcaaaatcttcatcatgatcgttggtggtctgatcggtctgcgtatcatcttcgctgttctgtccatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 146 - DNA, 6718 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctaccttcaaaaacaacgttaccaacgacatgaacaaagaaatccgtaactgctccttcgcatgcatcaactgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtccgaacaacaacacccgtaaatccatgcgtatcggtccgggtcagaccttctacgctaccggtgacatcatcggtgacatccgtcaggcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccacccgtctgttcaacaacaacgctaccgaagacgaaaccatcaccctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtacatcaaaatcttcatcatgatcgttggtggtctgatcggtctgcgtatcatcttcgctgttctgtccatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 147 - DNA, 6637 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctaccttcaaaaacaacgttaccaacgacatgaacaaagaaatccgtaactgctccttcgcatgcatcaactgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtgctagcgcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccacccgtctgttcaacaacaacgctaccgaagacgaaaccatcaccctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtacatcaaaatcttcatcatgatcgttggtggtctgatcggtctgcgtatcatcttcgctgttctgtccatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 148 - DNA, 6598 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctaccttcaaaaacaacgttaccaacgacatgaacaaagaaatccgtaactgctccttcgcatgcatcaactgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtgctagcgcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccgctagcctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtacatcaaaatcttcatcatgatcgttggtggtctgatcggtctgcgtatcatcttcgctgttctgtccatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 149 - DNA, 6679 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctaccttcaaaaacaacgttaccaacgacatgaacaaagaaatccgtaactgctccttcgcatgcatcaactgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtccgaacaacaacacccgtaaatccatgcgtatcggtccgggtcagaccttctacgctaccggtgacatcatcggtgacatccgtcaggcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccgctagcctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtacatcaaaatcttcatcatgatcgttggtggtctgatcggtctgcgtatcatcttcgctgttctgtccatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 150 - DNA, 6748 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctaccttcaaaaacaacgttaccaacgacatgaacaaagaaatccgtaactgctccttcaacaccaccaccgaaatccgtgacaaaaaacagcagggttacgctctgttctaccgtccggacatcgttctgctgaaagaaaaccgtaacaactccaacaactccgaatacatcctgatcaactgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtgctagcgcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccacccgtctgttcaacaacaacgctaccgaagacgaaaccatcaccctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtacatcaaaatcttcatcatgatcgttggtggtctgatcggtctgcgtatcatcttcgctgttctgtccatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 151 - DNA, 6709 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctaccttcaaaaacaacgttaccaacgacatgaacaaagaaatccgtaactgctccttcaacaccaccaccgaaatccgtgacaaaaaacagcagggttacgctctgttctaccgtccggacatcgttctgctgaaagaaaaccgtaacaactccaacaactccgaatacatcctgatcaactgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtgctagcgcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccgctagcctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtacatcaaaatcttcatcatgatcgttggtggtctgatcggtctgcgtatcatcttcgctgttctgtccatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 152 - DNA, 6790 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctaccttcaaaaacaacgttaccaacgacatgaacaaagaaatccgtaactgctccttcaacaccaccaccgaaatccgtgacaaaaaacagcagggttacgctctgttctaccgtccggacatcgttctgctgaaagaaaaccgtaacaactccaacaactccgaatacatcctgatcaactgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtccgaacaacaacacccgtaaatccatgcgtatcggtccgggtcagaccttctacgctaccggtgacatcatcggtgacatccgtcaggcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccgctagcctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtacatcaaaatcttcatcatgatcgttggtggtctgatcggtctgcgtatcatcttcgctgttctgtccatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 153 - DNA, 6637 bp, Artificial Sequence; identical to SEQ ID NO: 132
  plasmid pVR1012x/s containing HIV genes

SEQ ID NO: 154 - DNA, 6670 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctagccgtaactgctccttcaacaccaccaccgaaatccgtgacaaaaaacagcagggttacgctctgttctaccgtccggacatcgttctgctgaaagaaaaccgtaacaactccaacaactccgaatacatcctgatcaactgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtgctagcgcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccgctagcctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtacatcaaaatcttcatcatgatcgttggtggtctgatcggtctgcgtatcatcttcgctgttctgtccatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 155 - DNA, 6547 bp, Artificial Sequence; identical to SEQ ID NO: 131
  plasmid pVR1012x/s containing HIV genes

SEQ ID NO: 156 - DNA, 6679 bp, Artificial Sequence; identical to SEQ ID NO: 134
  plasmid pVR1012x/s containing HIV genes

SEQ ID NO: 157 - DNA, 6438 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacatgggcgcccgcgccagcgtgctgagcggcggcgagctggaccgctgggagaagatccgcctgcgccccggcggcaagaagaagtacaagctgaagcacatcgtgtgggccagccgcgagctggagcgcttcgccgtgaaccccggcctgctggagaccagcgagggctgccgccagatcctgggccagctgcagcccagcctgcagaccggcagcgaggagctgcgcagcctgtacaacaccgtggccaccctgtactgcgtgcaccagcgcatcgagatcaaggacaccaaggaggccctggacaagatcgaggaggagcagaacaagagcaagaagaaggcccagcaggccgccgccgacaccggccacagcaaccaggtgagccagaactaccccatcgtgcagaacatccagggccagatggtgcaccaggccatcagcccccgcaccctgaacgcctgggtgaaggtggtggaggagaaggccttcagccccgaggtgatccccatgttcagcgccctgagcgagggcgccaccccccaggacctgaacaccatgctgaacaccgtgggcggccaccaggccgccatgcagatgctgaaggagaccatcaacgaggaggccgccgagtgggaccgcgtgcaccccgtgcacgccggccccatcgcccccggccagatgcgcgagccccgcggcagcgacatcgccggcaccaccagcaccctgcaggagcagatcggctggatgaccaacaacccccccatccccgtgggcgagatctacaagcgctggatcatcctgggcctgaacaagatcgtgcgcatgtacagccccaccagcatcctggacatccgccagggccccaaggagcccttccgcgactacgtggaccgcttctacaagaccctgcgcgccgagcaggccagccaggaggtgaagaactggatgaccgagaccctgctggtgcagaacgccaaccccgactgcaagaccatcctgaaggccctgggccccgccgccaccctggaggagatgatgaccgcctgccagggcgtgggcggccccggccacaaggcccgcgtgctggccgaggccatgagccaggtgaccaacagcgccaccatcatgatgcagcgcggcaacttccgcaaccagcgcaagatcgtgaagtgcttcaactgcggcaaggagggccacaccgcccgcaactgccgcgccccccgcaagaagggctgctggaagtgcggcaaggagggccaccagatgaaggactgcaccgagcgacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagatagggggccagctgaaggaggcccttctagaccaggccctggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 158 - DNA, 6486 bp, Artificial Sequence
  plasmid pVR1012x/s containing SIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacgccgccaccatgggcgtgcgcaacagcgtgctgagcggcaagaaggccgacgagctggagaagatccgcctgcgcccgaacggcaagaagaagtacatgctgaagcacgtggtgtgggccgccaacgagctggaccgcttcggcctggccgagagcctgctggagaacaaggagggctgccagaagatcctgagcgtgctggcgccgctggtgcccaccggcagcgagaacctgaagagcctgtacaacaccgtgtgcgtgatctggtgcatccacgccgaggagaaggtgaagcacaccgaggaggccaagcagatcgtgcagcgccacctggtggtggagaccggcaccaccgagaccatgcccaagaccagccgcccgaccgcgcccagcagcggacgcggcggcaactacccggtgcagcagatcggcggcaactacgtgcacctgccgctgagcccgcgcaccctgaacgcctgggtgaagctgatcgaggagaagaagttcggcgccgaggtggtgcccggcttccaggccctgagcgagggctgcacgccctacgacatcaaccagatgctgaactgcgtgggcgaccaccaggccgccatgcagatcatccgcgacatcatcaacgaggaggccgccgactgggacctgcagcacccgcagcccgcgccgcagcagggccagctgcgcgagcccagcggcagcgacatcgccggcaccaccagcagcgtggacgagcagatccagtggatgtaccgccagcagaacccgatcccggtgggcaacatctaccgccgctggatacagctgggcctgcagaagtgcgtgcgcatgtacaacccgaccaacatcctggacgtgaagcagggcccgaaggagcccttccagagctacgtggaccgcttctacaagagcctgcgcgccgagcagaccgacgccgccgtgaagaactggatgacccagaccctgctgatccagaacgccaacccggactgcaagctggtgctgaagggcctgggcgtgaacccgaccctggaggagatgctgaccgcctgccagggcgtgggcggcccgggccagaaggcccgcctgatggccgaggccctgaaggaggccctggcgcccgtgcccatcccgttcgcggccgcccagcagcgcggcccgcgcaagcccatcaagtgctggaactgcggcaaggagggccacagcgcccgccagtgccgcgcgccgcgccgccagggctgctggaagtgcggcaagatggaccacgtgatggccaagtgcccggaccgccaggcgggttttttaggccttggtccatggggaaagaagccgcgcaatttcccgatggctcaagtgcatcaggggctgatgccaactgctccgccagaggacccagctgtggatctgctaaagaactacatgcagttgggcaagcagcagagagaaaagcagagagaaagcagagagaagccttacaaggaggtgacagaggatttgctgcacctcaattctctctttggaggagaccagtagtcactgcatcgatcgagggccagcccgtggaggtgcttctagaccaggccctggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 159 - DNA, 9189 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacatgggcgcccgcgccagcgtgctgagcggcggcgagctggaccgctgggagaagatccgcctgcgccccggcggcaagaagaagtacaagctgaagcacatcgtgtgggccagccgcgagctggagcgcttcgccgtgaaccccggcctgctggagaccagcgagggctgccgccagatcctgggccagctgcagcccagcctgcagaccggcagcgaggagctgcgcagcctgtacaacaccgtggccaccctgtactgcgtgcaccagcgcatcgagatcaaggacaccaaggaggccctggacaagatcgaggaggagcagaacaagagcaagaagaaggcccagcaggccgccgccgacaccggccacagcaaccaggtgagccagaactaccccatcgtgcagaacatccagggccagatggtgcaccaggccatcagcccccgcaccctgaacgcctgggtgaaggtggtggaggagaaggccttcagccccgaggtgatccccatgttcagcgccctgagcgagggcgccaccccccaggacctgaacaccatgctgaacaccgtgggcggccaccaggccgccatgcagatgctgaaggagaccatcaacgaggaggccgccgagtgggaccgcgtgcaccccgtgcacgccggccccatcgcccccggccagatgcgcgagccccgcggcagcgacatcgccggcaccaccagcaccctgcaggagcagatcggctggatgaccaacaacccccccatccccgtgggcgagatctacaagcgctggatcatcctgggcctgaacaagatcgtgcgcatgtacagccccaccagcatcctggacatccgccagggccccaaggagcccttccgcgactacgtggaccgcttctacaagaccctgcgcgccgagcaggccagccaggaggtgaagaactggatgaccgagaccctgctggtgcagaacgccaaccccgactgcaagaccatcctgaaggccctgggccccgccgccaccctggaggagatgatgaccgcctgccagggcgtgggcggccccggccacaaggcccgcgtgctggccgaggccatgagccaggtgaccaacagcgccaccatcatgatgcagcgcggcaacttccgcaaccagcgcaagatcgtgaagtgcttcaactgcggcaaggagggccacaccgcccgcaactgccgcgccccccgcaagaagggctgctggaagtgcggcaaggagggccaccagatgaaggactgcaccgagcgacaggctaatagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagatagggggccagctgaaggaggcccttctagacaccggcgccgacgacaccgtgctggaggagatgaacctgcccggccgctggaagcccaagatgatcggcggcatcggcggcttcatcaaggtgggccagtacgaccagatcctgatcgagatctgcggccacaaggccatcggcaccgtgctggtgggccccacccccgtgaacatcatcggccgcaacctgctgacccagatcggctgcaccctgaacttccccatcagccccatcgagaccgtgcccgtgaagctgaagcccggcatggacggccccaaggtgaagcagtggcccctgaccgaggagaagatcaaggccctggtggagatctgcaccgagatggagaaggagggcaagatcagcaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagcagaagaagagcgtgaccgtgctggacgtgggcgacgcctacttcagcgtgcccctggacaaggacttccgcaagtacaccgccttcaccatccccagcatcaacaacgagacccccggcatccgctaccagtacaacgtgctgccccagggctggaagggcagccccgccatcttccagtgcagcatgaccaagatcctggagcccttccgcaagcagaaccccgacatcgtgatctaccagtacatggacgacctgtacgtgggcagcgacctggagatcggccagcaccgcaccaagatcgaggagctgcgccagcacctgctgcgctggggcttcaccacccccgacaagaagcaccagaaggagccccccttcctgtggatgggctacgagctgcaccccgacaagtggaccgtgcagcccatcgtgctgcccgagaaggacagctggaccgtgaacgacatccagaagctggtgggcaagctgaactgggccagccagatctacgccggcatcaaggtgcgccagctgtgcaagctgctgcgcggcaccaaggccctgaccgaggtggtgcccctgaccgaggaggccgagctggagctggccgagaaccgcgagatcctgaaggagcccgtgcacggcgtgtactacgaccccagcaaggacctgatcgccgagatccagaagcagggccagggccagtggacctaccagatctaccaggagcccttcaagaacctgaagaccggcaagtacgcccgcatgaagggcgcccacaccaacgacgtgaagcagctgaccgaggccgtgcagaagatcgccaccgagagcatcgtgatctggggcaagacccccaagttcaagctgcccatccagaaggagacctgggaggcctggtggaccgagtactggcaggccacctggatccccgagtgggagttcgtgaacaccccccccctggtgaagctgtggtaccagctggagaaggagcccatcatcggcgccgagaccttctacgtggacggcgccgccaaccgcgagaccaagctgggcaaggccggctacgtgaccgaccgcggccgccagaaggtggtgcccctgaccgacaccaccaaccagaagaccgagctgcaggccatccacctggccctgcaggacagcggcctggaggtgaacatcgtgaccgacagccagtacgccctgggcatcatccaggcccagcccgacaagagcgagagcgagctggtgagccagatcatcgagcagctgatcaagaaggagaaggtgtacctggcctgggtgcccgcccacaagggcatcggcggcaacgagcaggtggacggcctggtgagcgccggcatccgcaaggtgctgttcctggacggcatcgacaaggcccaggaggagcacgagaagtaccacagcaactggcgcgccatggccagcgacttcaacctgccccccgtggtggccaaggagatcgtggccagctgcgacaagtgccagctgaagggcgaggccatgcacggccaggtggactgcagccccggcatctggcagctggactgcacccacctggagggcaaggtgatcctggtggccgtgcacgtggccagcggctacatcgaggccgaggtgatccccgccgagaccggccaggagaccgcctacttcctgctgaagctggccggccgctggcccgtgaagaccgtgcacaccgacaacggcagcaacttcaccagcaccaccgtgaaggccgcctgctggtgggccggcatcaagcaggagttcggcatcccctacaacccccagagccagggcgtgatcgagagcatgaacaaggagctgaagaagatcatcggccaggtgcgcgaccaggccgagcacctgaagaccgccgtgcagatggccgtgttcatccacaacttcaagcgcaagggcggcatcggcggctacagcgccggcgagcgcatcgtggacatcatcgccaccgacatccagaccaaggagctgcagaagcagatcaccaagatccagaacttccgcgtgtactaccgcgacagccgcgaccccgtgtggaagggccccgccaagctgctgtggaagggcgagggcgccgtggtgatccaggacaacagcgacatcaaggtggtgccccgccgcaaggccaagatcatccgcgactacggcaagcagatggccggcgacgactgcgtggccagccgccaggacgaggactaggaattctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 160 - DNA, 9285 bp, Artificial Sequence
  plasmid pVR1012x/s containing SIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacgccgccaccatgggcgtgcgcaacagcgtgctgagcggcaagaaggccgacgagctggagaagatccgcctgcgcccgaacggcaagaagaagtacatgctgaagcacgtggtgtgggccgccaacgagctggaccgcttcggcctggccgagagcctgctggagaacaaggagggctgccagaagatcctgagcgtgctggcgccgctggtgcccaccggcagcgagaacctgaagagcctgtacaacaccgtgtgcgtgatctggtgcatccacgccgaggagaaggtgaagcacaccgaggaggccaagcagatcgtgcagcgccacctggtggtggagaccggcaccaccgagaccatgcccaagaccagccgcccgaccgcgcccagcagcggacgcggcggcaactacccggtgcagcagatcggcggcaactacgtgcacctgccgctgagcccgcgcaccctgaacgcctgggtgaagctgatcgaggagaagaagttcggcgccgaggtggtgcccggcttccaggccctgagcgagggctgcacgccctacgacatcaaccagatgctgaactgcgtgggcgaccaccaggccgccatgcagatcatccgcgacatcatcaacgaggaggccgccgactgggacctgcagcacccgcagcccgcgccgcagcagggccagctgcgcgagcccagcggcagcgacatcgccggcaccaccagcagcgtggacgagcagatccagtggatgtaccgccagcagaacccgatcccggtgggcaacatctaccgccgctggatacagctgggcctgcagaagtgcgtgcgcatgtacaacccgaccaacatcctggacgtgaagcagggcccgaaggagcccttccagagctacgtggaccgcttctacaagagcctgcgcgccgagcagaccgacgccgccgtgaagaactggatgacccagaccctgctgatccagaacgccaacccggactgcaagctggtgctgaagggcctgggcgtgaacccgaccctggaggagatgctgaccgcctgccagggcgtgggcggcccgggccagaaggcccgcctgatggccgaggccctgaaggaggccctggcgcccgtgcccatcccgttcgcggccgcccagcagcgcggcccgcgcaagcccatcaagtgctggaactgcggcaaggagggccacagcgcccgccagtgccgcgcgccgcgccgccagggctgctggaagtgcggcaagatggaccacgtgatggccaagtgcccggaccgccaggcgggttttttaggccttggtccatggggaaagaagccgcgcaatttcccgatggctcaagtgcatcaggggctgatgccaactgctccgccagaggacccagctgtggatctgctaaagaactacatgcagttgggcaagcagcagagagaaaagcagagagaaagcagagagaagccttacaaggaggtgacagaggatttgctgcacctcaattctctctttggaggagaccagtagtcactgcatcgatcgagggccagcccgtggaggtgcttctagacaccggcgccgacgacagcatcgtgaccggcatcgagctgggcccgcactacaccccgaagatcgtgggcggcatcggcggcttcatcaacaccggagagtacaagaacgtggagatcgaggtgctgggcaagcgcatcaagggcaccatcatgaccggcgacacgcccatcaacatcttcggccgcaacctgctgaccgccctgggcatgagcctgaacttccccatcgccaaggtggagcccgtgaaggtggccctgaagcccggcaaggacggccccaagctgaagcagtggcccctgagcaaggagaagatcgtggccctgcgcgagatctgcgagaagatggagaaggacggccagctggaggaggccccacccaccaacccctacaacacgcccaccttcgccatcaagaagaaggacaagaacaagtggcgcatgctgatcgacttccgcgagctgaaccgcgtgacccaggacttcaccgaggtgcagctgggcatcccgcaccccgccggcctggccaagcgcaagcgcatcaccgtgctggacatcggcgacgcctacttcagcatccccctggacgaggagttccgccagtacaccgccttcaccctgcccagcgtgaacaacgccgagcccggcaagcgctacatctacaaggtgctgccccagggctggaagggcagccccgccatcttccagtacaccatgcgccacgtgctggagcccttccgcaaggccaaccccgacgtgaccctggtgcagtacatgcatgacatcctgatcgccagcgaccgcaccgacctggagcacgaccgcgtggtgctgcagagcaaggagctgctgaacagcatcggcttcagcacgcccgaggagaagttccagaaggacccacccttccagtggatgggctacgagctgtggcccaccaagtggaagctgcagaagatcgagctgccccagcgcgagacctggaccgtgaacgacatccagaagctggtgggcgtgctgaactgggccgcccagatctaccccggcatcaagaccaagcacctgtgccgcctgatccgcggcaagatgaccctgaccgaggaggtgcagtggaccgagatggccgaggccgagtacgaggagaacaagatcatcctgagccaggagcaggagggctgctactaccaggagggcaagcccctggaggccaccgtgatcaagagccaggacaaccagtggagctacaagatccaccaggaggacaagatcctgaaggtgggcaagttcgccaagatcaagaacacccacaccaacggcgtgcgcctgctggcccacgtgatccagaagatcggcaaggaggccatcgtgatctggggccaggtgcccaagttccacctgcccgtggagaaggacgtgtgggagcagtggtggaccgactactggcaggtgacctggatacccgagtgggacttcatcagcacccctcccctggtgcgcctggtgttcaacctggtgaaggaccccatcgagggcgaggagacctactacaccgacggcagctgcaacaagcagagcaaggagggcaaggccggctacatcaccgaccgcggcaaggacaaggtgaaggtgctggagcagaccaccaaccagcaggccgagctcgaggccttcctgatggccctgaccgacagcggccccaaggccaacatcatcgtggacagccagtacgtgatgggcatcatcaccggctgccccaccgagagcgagagccgcctggtgaaccagatcatcgaggagatgatcaagaagagcgagatctacgtggcctgggtgcccgcccacaagggcatcggcggcaaccaggagatcgaccacctggtgagccagggcatccgccaggtgctgttcctggagaagatcgagcccgcccaggaggagcacgacaagtaccacagcaacgtgaaggagctggtgttcaagttcggcctgccccgcatcgtggcccgccagatcgtggacacctgcgacaagtgccaccagaagggcgaggccatccacggccaggccaacagcgacctgggcacctggcagatggcctgcacccacctggagggcaagatcatcatcgtggccgtgcacgtggccagcggcttcatcgaggccgaggtgatcccgcaggagaccggccgccagaccgccctgttcctgctgaagctggccggccgctggcccatcacccacctgcacaccgacaacggcgccaacttcgccagccaggaggtgaagatggtggcctggtgggccggcatcgagcacaccttcggcgtgccctacaacccgcagagccagggcgtggtggaggccatgaaccaccacctgaagaaccagatcgaccgcatccgcgagcaggccaacagcgtggagaccatcgtgctgatggccgtgcactgcatgaacttcaagcgccgcggcggcatcggcgacatgacgcccgccgagcgcctgatcaacatgatcaccaccgagcaggagatccagttccagcagagcaagaacagcaagttcaagaacttccgcgtgtactaccgcgagggccgcgaccagctgtggaagggccccggcgagctgctgtggaagggcgagggcgccgtgatcctgaaggtgggcaccgacatcaaggtggtgccccgccgcaaggccaagatcatcaaggactacggcggcggcaaggaggtggacagcagcagccacatggaggacaccggcgaggcccgcgaggtggcctgagaattcgtttaaacacgcgtgtatacggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 161 - DNA, 7897 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacatgagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagatagggggccagctgaaggaggcccttctagacaccggcgccgacgacaccgtgctggaggagatgaacctgcccggccgctggaagcccaagatgatcggcggcatcggcggcttcatcaaggtgggccagtacgaccagatcctgatcgagatctgcggccacaaggccatcggcaccgtgctggtgggccccacccccgtgaacatcatcggccgcaacctgctgacccagatcggctgcaccctgaacttccccatcagccccatcgagaccgtgcccgtgaagctgaagcccggcatggacggccccaaggtgaagcagtggcccctgaccgaggagaagatcaaggccctggtggagatctgcaccgagatggagaaggagggcaagatcagcaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagcagaagaagagcgtgaccgtgctggacgtgggcgacgcctacttcagcgtgcccctggacaaggacttccgcaagtacaccgccttcaccatccccagcatcaacaacgagacccccggcatccgctaccagtacaacgtgctgccccagggctggaagggcagccccgccatcttccagtgcagcatgaccaagatcctggagcccttccgcaagcagaaccccgacatcgtgatctaccagtacatggacgacctgtacgtgggcagcgacctggagatcggccagcaccgcaccaagatcgaggagctgcgccagcacctgctgcgctggggcttcaccacccccgacaagaagcaccagaaggagccccccttcctgtggatgggctacgagctgcaccccgacaagtggaccgtgcagcccatcgtgctgcccgagaaggacagctggaccgtgaacgacatccagaagctggtgggcaagctgaactgggccagccagatctacgccggcatcaaggtgcgccagctgtgcaagctgctgcgcggcaccaaggccctgaccgaggtggtgcccctgaccgaggaggccgagctggagctggccgagaaccgcgagatcctgaaggagcccgtgcacggcgtgtactacgaccccagcaaggacctgatcgccgagatccagaagcagggccagggccagtggacctaccagatctaccaggagcccttcaagaacctgaagaccggcaagtacgcccgcatgaagggcgcccacaccaacgacgtgaagcagctgaccgaggccgtgcagaagatcgccaccgagagcatcgtgatctggggcaagacccccaagttcaagctgcccatccagaaggagacctgggaggcctggtggaccgagtactggcaggccacctggatccccgagtgggagttcgtgaacaccccccccctggtgaagctgtggtaccagctggagaaggagcccatcatcggcgccgagaccttctacgtggacggcgccgccaaccgcgagaccaagctgggcaaggccggctacgtgaccgaccgcggccgccagaaggtggtgcccctgaccgacaccaccaaccagaagaccgagctgcaggccatccacctggccctgcaggacagcggcctggaggtgaacatcgtgaccgacagccagtacgccctgggcatcatccaggcccagcccgacaagagcgagagcgagctggtgagccagatcatcgagcagctgatcaagaaggagaaggtgtacctggcctgggtgcccgcccacaagggcatcggcggcaacgagcaggtggacggcctggtgagcgccggcatccgcaaggtgctgttcctggacggcatcgacaaggcccaggaggagcacgagaagtaccacagcaactggcgcgccatggccagcgacttcaacctgccccccgtggtggccaaggagatcgtggccagctgcgacaagtgccagctgaagggcgaggccatgcacggccaggtggactgcagccccggcatctggcagctggactgcacccacctggagggcaaggtgatcctggtggccgtgcacgtggccagcggctacatcgaggccgaggtgatccccgccgagaccggccaggagaccgcctacttcctgctgaagctggccggccgctggcccgtgaagaccgtgcacaccgacaacggcagcaacttcaccagcaccaccgtgaaggccgcctgctggtgggccggcatcaagcaggagttcggcatcccctacaacccccagagccagggcgtgatcgagagcatgaacaaggagctgaagaagatcatcggccaggtgcgcgaccaggccgagcacctgaagaccgccgtgcagatggccgtgttcatccacaacttcaagcgcaagggcggcatcggcggctacagcgccggcgagcgcatcgtggacatcatcgccaccgacatccagaccaaggagctgcagaagcagatcaccaagatccagaacttccgcgtgtactaccgcgacagccgcgaccccgtgtggaagggccccgccaagctgctgtggaagggcgagggcgccgtggtgatccaggacaacagcgacatcaaggtggtgccccgccgcaaggccaagatcatccgcgactacggcaagcagatggccggcgacgactgcgtggccagccgccaggacgaggactaggaatttctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 162 - DNA, 7984 bp, Artificial Sequence
  plasmid pVR1012x/s containing SIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacgccgccaccatgaggccttggtccatggggaaagaagccccgcaatttccccatggctcaagtgcatcaggggctgatgccaactgctccccgagaggacccagctgtggatctgctaaagaactacatgcagttgggcaagcagcagagagaaaagcagagagaaagcagagagaagccttacaaggaggtgacagaggatttgctgcacctcaattctctctttggaggagaccagtagtcactgcatcgatcgagggccagcccgtggaggtgcttctagacaccggcgccgacgacagcatcgtgaccggcatcgagctgggcccgcactacaccccgaagatcgtgggcggcatcggcggcttcatcaacaccggagagtacaagaacgtggagatcgaggtgctgggcaagcgcatcaagggcaccatcatgaccggcgacacgcccatcaacatcttcggccgcaacctgctgaccgccctgggcatgagcctgaacttccccatcgccaaggtggagcccgtgaaggtggccctgaagcccggcaaggacggccccaagctgaagcagtggcccctgagcaaggagaagatcgtggccctgcgcgagatctgcgagaagatggagaaggacggccagctggaggaggccccacccaccaacccctacaacacgcccaccttcgccatcaagaagaaggacaagaacaagtggcgcatgctgatcgacttccgcgagctgaaccgcgtgacccaggacttcaccgaggtgcagctgggcatcccgcaccccgccggcctggccaagcgcaagcgcatcaccgtgctggacatcggcgacgcctacttcagcatccccctggacgaggagttccgccagtacaccgccttcaccctgcccagcgtgaacaacgccgagcccggcaagcgctacatctacaaggtgctgccccagggctggaagggcagccccgccatcttccagtacaccatgcgccacgtgctggagcccttccgcaaggccaaccccgacgtgaccctggtgcagtacatgcatgacatcctgatcgccagcgaccgcaccgacctggagcacgaccgcgtggtgctgcagagcaaggagctgctgaacagcatcggcttcagcacgcccgaggagaagttccagaaggacccacccttccagtggatgggctacgagctgtggcccaccaagtggaagctgcagaagatcgagctgccccagcgcgagacctggaccgtgaacgacatccagaagctggtgggcgtgctgaactgggccgcccagatctaccccggcatcaagaccaagcacctgtgccgcctgatccgcggcaagatgaccctgaccgaggaggtgcagtggaccgagatggccgaggccgagtacgaggagaacaagatcatcctgagccaggagcaggagggctgctactaccaggagggcaagcccctggaggccaccgtgatcaagagccaggacaaccagtggagctacaagatccaccaggaggacaagatcctgaaggtgggcaagttcgccaagatcaagaacacccacaccaacggcgtgcgcctgctggcccacgtgatccagaagatcggcaaggaggccatcgtgatctggggccaggtgcccaagttccacctgcccgtggagaaggacgtgtgggagcagtggtggaccgactactggcaggtgacctggatacccgagtgggacttcatcagcacccctcccctggtgcgcctggtgttcaacctggtgaaggaccccatcgagggcgaggagacctactacaccgacggcagctgcaacaagcagagcaaggagggcaaggccggctacatcaccgaccgcggcaaggacaaggtgaaggtgctggagcagaccaccaaccagcaggccgagctcgaggccttcctgatggccctgaccgacagcggccccaaggccaacatcatcgtggacagccagtacgtgatgggcatcatcaccggctgccccaccgagagcgagagccgcctggtgaaccagatcatcgaggagatgatcaagaagagcgagatctacgtggcctgggtgcccgcccacaagggcatcggcggcaaccaggagatcgaccacctggtgagccagggcatccgccaggtgctgttcctggagaagatcgagcccgcccaggaggagcacgacaagtaccacagcaacgtgaaggagctggtgttcaagttcggcctgccccgcatcgtggcccgccagatcgtggacacctgcgacaagtgccaccagaagggcgaggccatccacggccaggccaacagcgacctgggcacctggcagatggcctgcacccacctggagggcaagatcatcatcgtggccgtgcacgtggccagcggcttcatcgaggccgaggtgatcccgcaggagaccggccgccagaccgccctgttcctgctgaagctggccggccgctggcccatcacccacctgcacaccgacaacggcgccaacttcgccagccaggaggtgaagatggtggcctggtgggccggcatcgagcacaccttcggcgtgccctacaacccgcagagccagggcgtggtggaggccatgaaccaccacctgaagaaccagatcgaccgcatccgcgagcaggccaacagcgtggagaccatcgtgctgatggccgtgcactgcatgaacttcaagcgccgcggcggcatcggcgacatgacgcccgccgagcgcctgatcaacatgatcaccaccgagcaggagatccagttccagcagagcaagaacagcaagttcaagaacttccgcgtgtactaccgcgagggccgcgaccagctgtggaagggccccggcgagctgctgtggaagggcgagggcgccgtgatcctgaaggtgggcaccgacatcaaggtggtgccccgccgcaaggccaagatcatcaaggactacggcggcggcaaggaggtggacagcagcagccacatggaggacaccggcgaggcccgcgaggtggcctgagaattcgtttaaacacgcgtgtatacggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 163 - DNA, 9194 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacatgggcgcccgcgccagcgtgctgagcggcggcgagctggaccgctgggagaagatccgcctgcgccccggcggcaagaagaagtacaagctgaagcacatcgtgtgggccagccgcgagctggagcgcttcgccgtgaaccccggcctgctggagaccagcgagggctgccgccagatcctgggccagctgcagcccagcctgcagaccggcagcgaggagctgcgcagcctgtacaacaccgtggccaccctgtactgcgtgcaccagcgcatcgagatcaaggacaccaaggaggccctggacaagatcgaggaggagcagaacaagagcaagaagaaggcccagcaggccgccgccgacaccggccacagcaaccaggtgagccagaactaccccatcgtgcagaacatccagggccagatggtgcaccaggccatcagcccccgcaccctgaacgcctgggtgaaggtggtggaggagaaggccttcagccccgaggtgatccccatgttcagcgccctgagcgagggcgccaccccccaggacctgaacaccatgctgaacaccgtgggcggccaccaggccgccatgcagatgctgaaggagaccatcaacgaggaggccgccgagtgggaccgcgtgcaccccgtgcacgccggccccatcgcccccggccagatgcgcgagccccgcggcagcgacatcgccggcaccaccagcaccctgcaggagcagatcggctggatgaccaacaacccccccatccccgtgggcgagatctacaagcgctggatcatcctgggcctgaacaagatcgtgcgcatgtacagccccaccagcatcctggacatccgccagggccccaaggagcccttccgcgactacgtggaccgcttctacaagaccctgcgcgccgagcaggccagccaggaggtgaagaactggatgaccgagaccctgctggtgcagaacgccaaccccgactgcaagaccatcctgaaggccctgggccccgccgccaccctggaggagatgatgaccgcctgccagggcgtgggcggccccggccacaaggcccgcgtgctggccgaggccatgagccaggtgaccaacagcgccaccatcatgatgcagcgcggcaacttccgcaaccagcgcaagatcgtgaagtgcttcaactgcggcaaggagggccacaccgcccgcaactgccgcgccccccgcaagaagggctgctggaagtgcggcaaggagggccaccagatgaaggactgcaccgagcgacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagatagggggccagctgaaggaggcccttctagacaccggcgccgacgacaccgtgctggaggagatgaacctgcccggccgctggaagcccaagatgatcggcggcatcggcggcttcatcaaggtgggccagtacgaccagatcctgatcgagatctgcggccacaaggccatcggcaccgtgctggtgggccccacccccgtgaacatcatcggccgcaacctgctgacccagatcggctgcaccctgaacttccccatcagccccatcgagaccgtgcccgtgaagctgaagcccggcatggacggccccaaggtgaagcagtggcccctgaccgaggagaagatcaaggccctggtggagatctgcaccgagatggagaaggagggcaagatcagcaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagcagaagaagagcgtgaccgtgctggacgtgggcgacgcctacttcagcgtgcccctggacaaggacttccgcaagtacaccgccttcaccatccccagcatcaacaacgagacccccggcatccgctaccagtacaacgtgctgccccagggctggaagggcagccccgccatcttccagtgcagcatgaccaagatcctggagcccttccgcaagcagaaccccgacatcgtgatctaccagtacatggacgacctgtacgtgggcagcgacctggagatcggccagcaccgcaccaagatcgaggagctgcgccagcacctgctgcgctggggcttcaccacccccgacaagaagcaccagaaggagccccccttcctgtggatgggctacgagctgcaccccgacaagtggaccgtgcagcccatcgtgctgcccgagaaggacagctggaccgtgaacgacatccagaagctggtgggcaagctgaactgggccagccagatctacgccggcatcaaggtgcgccagctgtgcaagctgctgcgcggcaccaaggccctgaccgaggtggtgcccctgaccgaggaggccgagctggagctggccgagaaccgcgagatcctgaaggagcccgtgcacggcgtgtactacgaccccagcaaggacctgatcgccgagatccagaagcagggccagggccagtggacctaccagatctaccaggagcccttcaagaacctgaagaccggcaagtacgcccgcatgaagggcgcccacaccaacgacgtgaagcagctgaccgaggccgtgcagaagatcgccaccgagagcatcgtgatctggggcaagacccccaagttcaagctgcccatccagaaggagacctgggaggcctggtggaccgagtactggcaggccacctggatccccgagtgggagttcgtgaacaccccccccctggtgaagctgtggtaccagctggagaaggagcccatcatcggcgccgagaccttctacgtggacggcgccgccaaccgcgagaccaagctgggcaaggccggctacgtgaccgaccgcggccgccagaaggtggtgcccctgaccgacaccaccaaccagaagaccgagctgcaggccatccacctggccctgcaggacagcggcctggaggtgaacatcgtgaccgacagccagtacgccctgggcatcatccaggcccagcccgacaagagcgagagcgagctggtgagccagatcatcgagcagctgatcaagaaggagaaggtgtacctggcctgggtgcccgcccacaagggcatcggcggcaacgagcaggtggacggcctggtgagcgccggcatccgcaaggtgctgttcctggacggcatcgacaaggcccaggaggagcacgagaagtaccacagcaactggcgcgccatggccagcgacttcaacctgccccccgtggtggccaaggagatcgtggccagctgcgacaagtgccagctgaagggcgaggccatgcacggccaggtggactgcagccccggcatctggcagctggactgcacccacctggagggcaaggtgatcctggtggccgtgcacgtggccagcggctacatcgaggccgaggtgatccccgccgagaccggccaggagaccgcctacttcctgctgaagctggccggccgctggcccgtgaagaccgtgcacaccgacaacggcagcaacttcaccagcaccaccgtgaaggccgcctgctggtgggccggcatcaagcaggagttcggcatcccctacaacccccagagccagggcgtgatcgagagcatgaacaaggagctgaagaagatcatcggccaggtgcgcgaccaggccgagcacctgaagaccgccgtgcagatggccgtgttcatccacaacttcaagcgcaagggcggcatcggcggctacagcgccggcgagcgcatcgtggacatcatcgccaccgacatccagaccaaggagctgcagaagcagatcaccaagatccagaacttccgcgtgtactaccgcgacagccgcgaccccgtgtggaagggccccgccaagctgctgtggaagggcgagggcgccgtggtgatccaggacaacagcgacatcaaggtggtgccccgccgcaaggccaagatcatccgcgactacggcaagcagatggccggcgacgactgcgtggccagccgccaggacgaggactaggaattctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 164 - DNA, 9194 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacatgggcgcccgcgccagcgtgctgagcggcggcgagctggaccgctgggagaagatccgcctgcgccccggcggcaagaagaagtacaagctgaagcacatcgtgtgggccagccgcgagctggagcgcttcgccgtgaaccccggcctgctggagaccagcgagggctgccgccagatcctgggccagctgcagcccagcctgcagaccggcagcgaggagctgcgcagcctgtacaacaccgtggccaccctgtactgcgtgcaccagcgcatcgagatcaaggacaccaaggaggccctggacaagatcgaggaggagcagaacaagagcaagaagaaggcccagcaggccgccgccgacaccggccacagcaaccaggtgagccagaactaccccatcgtgcagaacatccagggccagatggtgcaccaggccatcagcccccgcaccctgaacgcctgggtgaaggtggtggaggagaaggccttcagccccgaggtgatccccatgttcagcgccctgagcgagggcgccaccccccaggacctgaacaccatgctgaacaccgtgggcggccaccaggccgccatgcagatgctgaaggagaccatcaacgaggaggccgccgagtgggaccgcgtgcaccccgtgcacgccggccccatcgcccccggccagatgcgcgagccccgcggcagcgacatcgccggcaccaccagcaccctgcaggagcagatcggctggatgaccaacaacccccccatccccgtgggcgagatctacaagcgctggatcatcctgggcctgaacaagatcgtgcgcatgtacagccccaccagcatcctggacatccgccagggccccaaggagcccttccgcgactacgtggaccgcttctacaagaccctgcgcgccgagcaggccagccaggaggtgaagaactggatgaccgagaccctgctggtgcagaacgccaaccccgactgcaagaccatcctgaaggccctgggccccgccgccaccctggaggagatgatgaccgcctgccagggcgtgggcggccccggccacaaggcccgcgtgctggccgaggccatgagccaggtgaccaacagcgccaccatcatgatgcagcgcggcaacttccgcaaccagcgcaagatcgtgaagtgcttcaactgcggcaaggagggccacaccgcccgcaactgccgcgccccccgcaagaagggctgctggaagtgcggcaaggagggccaccagatgaaggactgcaccgagcgacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagatagggggccagctgaaggaggcccttctagacaccggcgccgacgacaccgtgctggaggagatgaacctgcccggccgctggaagcccaagatgatcggcggcatcggcggcttcatcaaggtgggccagtacgaccagatcctgatcgagatctgcggccacaaggccatcggcaccgtgctggtgggccccacccccgtgaacatcatcggccgcaacctgctgacccagatcggctgcaccctgaacttccccatcagccccatcgagaccgtgcccgtgaagctgaagcccggcatggacggccccaaggtgaagcagtggcccctgaccgaggagaagatcaaggccctggtggagatctgcaccgagatggagaaggagggcaagatcagcaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagcagaagaagagcgtgaccgtgctggacgtgggcgacgcctacttcagcgtgcccctggacaaggacttccgcaagtacaccgccttcaccatccccagcatcaacaacgagacccccggcatccgctaccagtacaacgtgctgccccagggctggaagggcagccccgccatcttccagtgcagcatgaccaagatcctggagcccttccgcaagcagaaccccgacatcgtgatctaccagtacatggaccacctgtacgtgggcagcgacctggagatcggccagcaccgcaccaagatcgaggagctgcgccagcacctgctgcgctggggcttcaccacccccgacaagaagcaccagaaggagccccccttcctgtggatgggctacgagctgcaccccgacaagtggaccgtgcagcccatcgtgctgcccgagaaggacagctggaccgtgaacgacatccagaagctggtgggcaagctgaactgggccagccagatctacgccggcatcaaggtgcgccagctgtgcaagctgctgcgcggcaccaaggccctgaccgaggtggtgcccctgaccgaggaggccgagctggagctggccgagaaccgcgagatcctgaaggagcccgtgcacggcgtgtactacgaccccagcaaggacctgatcgccgagatccagaagcagggccagggccagtggacctaccagatctaccaggagcccttcaagaacctgaagaccggcaagtacgcccgcatgaagggcgcccacaccaacgacgtgaagcagctgaccgaggccgtgcagaagatcgccaccgagagcatcgtgatctggggcaagacccccaagttcaagctgcccatccagaaggagacctgggaggcctggtggaccgagtactggcaggccacctggatccccgagtgggagttcgtgaacaccccccccctggtgaagctgtggtaccagctggagaaggagcccatcatcggcgccgagaccttctacgtggacggcgccgccaaccgcgagaccaagctgggcaaggccggctacgtgaccgaccgcggccgccagaaggtggtgcccctgaccgacaccaccaaccagaagaccgagctgcaggccatccacctggccctgcaggacagcggcctggaggtgaacatcgtgaccgacagccagtacgccctgggcatcatccaggcccagcccgacaagagcgagagcgagctggtgagccagatcatcgagcagctgatcaagaaggagaaggtgtacctggcctgggtgcccgcccacaagggcatcggcggcaacgagcaggtggacggcctggtgagcgccggcatccgcaaggtgctgttcctggacggcatcgacaaggcccaggaggagcacgagaagtaccacagcaactggcgcgccatggccagcgacttcaacctgccccccgtggtggccaaggagatcgtggccagctgcgacaagtgccagctgaagggcgaggccatgcacggccaggtggactgcagccccggcatctggcagctggcatgcacccacctggagggcaaggtgatcctggtggccgtgcacgtggccagcggctacatcgaggccgaggtgatccccgccgagaccggccaggagaccgcctacttcctgctgaagctggccggccgctggcccgtgaagaccgtgcacaccgacaacggcagcaacttcaccagcaccaccgtgaaggccgcctgctggtgggccggcatcaagcaggagttcggcatcccctacaacccccagagccagggcgtgatcgagagcatgaacaaggagctgaagaagatcatcggccaggtgcgcgaccaggccgagcacctgaagaccgccgtgcagatggccgtgttcatccacaacttcaagcgcaagggcggcatcggcggctacagcgccggcgagcgcatcgtggacatcatcgccaccgacatccagaccaaggagctgcagaagcagatcaccaagatccagaacttccgcgtgtactaccgcgacagccgcgaccccgtgtggaagggccccgccaagctgctgtggaagggcgagggcgccgtggtgatccaggacaacagcgacatcaaggtggtgccccgccgcaaggccaagatcatccgcgactacggcaagcagatggccggcgacgactgcgtggccagccgccaggacgaggactaggaattctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 165 - DNA, 12411 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacatgggcgcccgcgccagcgtgctgagcggcggcgagctggaccgctgggagaagatccgcctgcgccccggcggcaagaagaagtacaagctgaagcacatcgtgtgggccagccgcgagctggagcgcttcgccgtgaaccccggcctgctggagaccagcgagggctgccgccagatcctgggccagctgcagcccagcctgcagaccggcagcgaggagctgcgcagcctgtacaacaccgtggccaccctgtactgcgtgcaccagcgcatcgagatcaaggacaccaaggaggccctggacaagatcgaggaggagcagaacaagagcaagaagaaggcccagcaggccgccgccgacaccggccacagcaaccaggtgagccagaactaccccatcgtgcagaacatccagggccagatggtgcaccaggccatcagcccccgcaccctgaacgcctgggtgaaggtggtggaggagaaggccttcagccccgaggtgatccccatgttcagcgccctgagcgagggcgccaccccccaggacctgaacaccatgctgaacaccgtgggcggccaccaggccgccatgcagatgctgaaggagaccatcaacgaggaggccgccgagtgggaccgcgtgcaccccgtgcacgccggccccatcgcccccggccagatgcgcgagccccgcggcagcgacatcgccggcaccaccagcaccctgcaggagcagatcggctggatgaccaacaacccccccatccccgtgggcgagatctacaagcgctggatcatcctgggcctgaacaagatcgtgcgcatgtacagccccaccagcatcctggacatccgccagggccccaaggagcccttccgcgactacgtggaccgcttctacaagaccctgcgcgccgagcaggccagccaggaggtgaagaactggatgaccgagaccctgctggtgcagaacgccaaccccgactgcaagaccatcctgaaggccctgggccccgccgccaccctggaggagatgatgaccgcctgccagggcgtgggcggccccggccacaaggcccgcgtgctggccgaggccatgagccaggtgaccaacagcgccaccatcatgatgcagcgcggcaacttccgcaaccagcgcaagatcgtgaagtgcttcaactgcggcaaggagggccacaccgcccgcaactgccgcgccccccgcaagaagggctgctggaagtgcggcaaggagggccaccagatgaaggactgcaccgagcgacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagatagggggccagctgaaggaggcccttctagacaccggcgccgacgacaccgtgctggaggagatgaacctgcccggccgctggaagcccaagatgatcggcggcatcggcggcttcatcaaggtgggccagtacgaccagatcctgatcgagatctgcggccacaaggccatcggcaccgtgctggtgggccccacccccgtgaacatcatcggccgcaacctgctgacccagatcggctgcaccctgaacttccccatcagccccatcgagaccgtgcccgtgaagctgaagcccggcatggacggccccaaggtgaagcagtggcccctgaccgaggagaagatcaaggccctggtggagatctgcaccgagatggagaaggagggcaagatcagcaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagcagaagaagagcgtgaccgtgctggacgtgggcgacgcctacttcagcgtgcccctggacaaggacttccgcaagtacaccgccttcaccatccccagcatcaacaacgagacccccggcatccgctaccagtacaacgtgctgccccagggctggaagggcagccccgccatcttccagtgcagcatgaccaagatcctggagcccttccgcaagcagaaccccgacatcgtgatctaccagtacatggacgacctgtacgtgggcagcgacctggagatcggccagcaccgcaccaagatcgaggagctgcgccagcacctgctgcgctggggcttcaccacccccgacaagaagcaccagaaggagccccccttcctgtggatgggctacgagctgcaccccgacaagtggaccgtgcagcccatcgtgctgcccgagaaggacagctggaccgtgaacgacatccagaagctggtgggcaagctgaactgggccagccagatctacgccggcatcaaggtgcgccagctgtgcaagctgctgcgcggcaccaaggccctgaccgaggtggtgcccctgaccgaggaggccgagctggagctggccgagaaccgcgagatcctgaaggagcccgtgcacggcgtgtactacgaccccagcaaggacctgatcgccgagatccagaagcagggccagggccagtggacctaccagatctaccaggagcccttcaagaacctgaagaccggcaagtacgcccgcatgaagggcgcccacaccaacgacgtgaagcagctgaccgaggccgtgcagaagatcgccaccgagagcatcgtgatctggggcaagacccccaagttcaagctgcccatccagaaggagacctgggaggcctggtggaccgagtactggcaggccacctggatccccgagtgggagttcgtgaacaccccccccctggtgaagctgtggtaccagctggagaaggagcccatcatcggcgccgagaccttctacgtggacggcgccgccaaccgcgagaccaagctgggcaaggccggctacgtgaccgaccgcggccgccagaaggtggtgcccctgaccgacaccaccaaccagaagaccgagctgcaggccatccacctggccctgcaggacagcggcctggaggtgaacatcgtgaccgacagccagtacgccctgggcatcatccaggcccagcccgacaagagcgagagcgagctggtgagccagatcatcgagcagctgatcaagaaggagaaggtgtacctggcctgggtgcccgcccacaagggcatcggcggcaacgagcaggtggacggcctggtgagcgccggcatccgcaaggtgctgttcctggacggcatcgacaaggcccaggaggagcacgagaagtaccacagcaactggcgcgccatggccagcgacttcaacctgccccccgtggtggccaaggagatcgtggccagctgcgacaagtgccagctgaagggcgaggccatgcacggccaggtggactgcagccccggcatctggcagctggactgcacccacctggagggcaaggtgatcctggtggccgtgcacgtggccagcggctacatcgaggccgaggtgatccccgccgagaccggccaggagaccgcctacttcctgctgaagctggccggccgctggcccgtgaagaccgtgcacaccgacaacggcagcaacttcaccagcaccaccgtgaaggccgcctgctggtgggccggcatcaagcaggagttcggcatcccctacaacccccagagccagggcgtgatcgagagcatgaacaaggagctgaagaagatcatcggccaggtgcgcgaccaggccgagcacctgaagaccgccgtgcagatggccgtgttcatccacaacttcaagcgcaagggcggcatcggcggctacagcgccggcgagcgcatcgtggacatcatcgccaccgacatccagaccaaggagctgcagaagcagatcaccaagatccagaacttccgcgtgtactaccgcgacagccgcgaccccgtgtggaagggccccgccaagctgctgtggaagggcgagggcgccgtggtgatccaggacaacagcgacatcaaggtggtgccccgccgcaaggccaagatcatccgcgactacggcaagcagatggccggcgacgactgcgtggccagccgccaggacgaggactaggaattcacgcgtcgagcatgcatctagggcggccaattccgcccctctccctcccccccccctaacgttactggccgaagccgcttggaataaggccggtgtgcgtttgtctatatgtgattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataagcttgccacaacccgggatcctctagaacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgttctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccatccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggcagcctggccgaggaggaggtggtgatccgcagcgccaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgcctgggcggcggcgacatgcgcgacaactggcgcagcgagctgtacaagtacaaggtggtgaagatcgagcccctgggcgtggcccccaccaaggccaagcgccgcgtggtgcagcgcgagaagcgcgccgtgggcatcggcgccctgttcctgggcttcctgggcgccgccggcagcaccatgggcgccgccagcatgaccctgaccgtgcaggcccgccagctgctgagcggcatcgtgcagcagcagaacaacctgctgcgcgccatcgaggcccagcagcacctgctgcagctgaccgtgtggggcatcaagcagctgcaggcccgcatcctggccgtggagcgctacctgaaggaccagcagctgctgggcatctggggctgcagcggcaagcttatctgcaccaccgccgtgccctggaacgccagctggagcaacaagagcctggagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatcgtgaaccgcgtgcgccagggctacagccccctgagcttccagacccacctgcccatcccccgcggccccgaccgccccgagggcatcgaggaggagggcggcgagcgcgaccgcgaccgcagcatccgcctggtgaacggcagcctggccctgatctgggacgacctgcgcagcctgtgcctgttcagctaccaccgcctgcgcgacctgctgctgatcgtgacccgcatcgtggagctgctgggccgccgcggctgggaggccctgaagtactggtggaacctgctgcagtactggagccaggagctgaagaacagcgccgtgagcctgctgaacgccaccgccatcgccgtggccgagggcaccgaccgcgtgatcgaggtggtgcagggcgcctgccgcgccatccgccacatcccccgccgcatccgccagggcctggagcgcatcctgctgtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 166 - DNA, 9170 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacatgggcgcccgcgccagcgtgctgagcggcggcgagctggaccgctgggagaagatccgcctgcgccccggcggcaagaagaagtacaagctgaagcacatcgtgtgggccagccgcgagctggagcgcttcgccgtgaaccccggcctgctggagaccagcgagggctgccgccagatcctgggccagctgcagcccagcctgcagaccggcagcgaggagctgcgcagcctgtacaacaccgtggccaccctgtactgcgtgcaccagcgcatcgagatcaaggacaccaaggaggccctggacaagatcgaggaggagcagaacaagagcaagaagaaggcccagcaggccgccgccgacaccggccacagcaaccaggtgagccagaactaccccatcgtgcagaacatccagggccagatggtgcaccaggccatcagcccccgcaccctgaacgcctgggtgaaggtggtggaggagaaggccttcagccccgaggtgatccccatgttcagcgccctgagcgagggcgccaccccccaggacctgaacaccatgctgaacaccgtgggcggccaccaggccgccatgcagatgctgaaggagaccatcaacgaggaggccgccgagtgggaccgcgtgcaccccgtgcacgccggccccatcgcccccggccagatgcgcgagccccgcggcagcgacatcgccggcaccaccagcaccctgcaggagcagatcggctggatgaccaacaacccccccatccccgtgggcgagatctacaagcgctggatcatcctgggcctgaacaagatcgtgcgcatgtacagccccaccagcatcctggacatccgccagggccccaaggagcccttccgcgactacgtggaccgcttctacaagaccctgcgcgccgagcaggccagccaggaggtgaagaactggatgaccgagaccctgctggtgcagaacgccaaccccgactgcaagaccatcctgaaggccctgggccccgccgccaccctggaggagatgatgaccgcctgccagggcgtgggcggccccggccacaaggcccgcgtgctggccgaggccatgagccaggtgaccaacagcgccaccatcatgatgcagcgcggcaacttccgcaaccagcgcaagatcgtgaagtgcttcaactgcggcaaggagggccacaccgcccgcaactgccgcgccccccgcaagaagggctgctggaagtgcggcaaggagggccaccagatgaaggactgcaccgagcgacaggctaatagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagatagggggccagctgaaggaggcccttctagacaccggcgccgacgacaccgtgctggaggagatgaacctgcccggccgctggaagcccaagatgatcggcggcatcggcggcttcatcaaggtgggccagtacgaccagatcctgatcgagatctgcggccacaaggccatcggcaccgtgctggtgggccccacccccgtgaacatcatcggccgcaacctgctgacccagatcggctgcaccctgaacttccccatcagccccatcgagaccgtgcccgtgaagctgaagcccggcatggacggccccaaggtgaagcagtggcccctgaccgaggagaagatcaaggccctggtggagatctgcaccgagatggagaaggagggcaagatcagcaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagcagaagaagagcgtgaccgtgctggacgtgggcgacgcctacttcagcgtgcccctggacaaggacttccgcaagtacaccgccttcaccatccccagcatcaacaacgagacccccggcatccgctaccagtacaacgtgctgccccagggctggaagggcagccccgccatcttccagtgcagcatgaccaagatcctggagcccttccgcaagcagaaccccgacatcgtgatctaccagtacatggaccacctgtacgtgggcagcgacctggagatcggccagcaccgcaccaagatcgaggagctgcgccagcacctgctgcgctggggcttcaccacccccgacaagaagcaccagaaggagccccccttcctgtggatgggctacgagctgcaccccgacaagtggaccgtgcagcccatcgtgctgcccgagaaggacagctggaccgtgaacgacatccagaagctggtgggcaagctgaactgggccagccagatctacgccggcatcaaggtgcgccagctgtgcaagctgctgcgcggcaccaaggccctgaccgaggtggtgcccctgaccgaggaggccgagctggagctggccgagaaccgcgagatcctgaaggagcccgtgcacggcgtgtactacgaccccagcaaggacctgatcgccgagatccagaagcagggccagggccagtggacctaccagatctaccaggagcccttcaagaacctgaagaccggcaagtacgcccgcatgaagggcgcccacaccaacgacgtgaagcagctgaccgaggccgtgcagaagatcgccaccgagagcatcgtgatctggggcaagacccccaagttcaagctgcccatccagaaggagacctgggaggcctggtggaccgagtactggcaggccacctggatccccgagtgggagttcgtgaacaccccccccctggtgaagctgtggtaccagctggagaaggagcccatcatcggcgccgagaccttctacgtggacggcgccgccaaccgcgagaccaagctgggcaaggccggctacgtgaccgaccgcggccgccagaaggtggtgcccctgaccgacaccaccaaccagaagaccgagctgcaggccatccacctggccctgcaggacagcggcctggaggtgaacatcgtgaccgacagccagtacgccctgggcatcatccaggcccagcccgacaagagcgagagcgagctggtgagccagatcatcgagcagctgatcaagaaggagaaggtgtacctggcctgggtgcccgcccacaagggcatcggcggcaacgagcaggtggacggcctggtgagcgccggcatccgcaaggtgctgttcctggacggcatcgacaaggcccaggaggagcacgagaagtaccacagcaactggcgcgccatggccagcgacttcaacctgccccccgtggtggccaaggagatcgtggccagctgcgacaagtgccagctgaagggcgaggccatgcacggccaggtggactgcagccccggcatctggcagctggcatgcacccacctggagggcaaggtgatcctggtggccgtgcacgtggccagcggctacatcgaggccgaggtgatccccgccgagaccggccaggagaccgcctacttcctgctgaagctggccggccgctggcccgtgaagaccgtgcacaccgacaacggcagcaacttcaccagcaccaccgtgaaggccgcctgctggtgggccggcatcaagcaggagttcggcatcccctacaacccccagagccagggcgtgatcgagagcatgaacaaggagctgaagaagatcatcggccaggtgcgcgaccaggccgagcacctgaagaccgccgtgcagatggccgtgttcatccacaacttcaagcgcaagggcggcatcggcggctacagcgccggcgagcgcatcgtggacatcatcgccaccgacatccagaccaaggagctgcagaagcagatcaccaagatccagaacttccgcgtgtactaccgcgacagccgcgaccccgtgtggaagggccccgccaagctgctgtggaagggcgagggcgccgtggtgatccaggacaacagcgacatcaaggtggtgccccgccgcaaggccaagatcatccgcgactacggcaagcagatggccggcgacgactgcgtggccagccgccaggacgaggactaggaattcttgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaatttcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 167 - DNA, 9280 bp, Artificial Sequence
  plasmid pVR1012x/s containing SIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacgccgccaccatgggcgtgcgcaacagcgtgctgagcggcaagaaggccgacgagctggagaagatccgcctgcgcccgaacggcaagaagaagtacatgctgaagcacgtggtgtgggccgccaacgagctggaccgcttcggcctggccgagagcctgctggagaacaaggagggctgccagaagatcctgagcgtgctggcgccgctggtgcccaccggcagcgagaacctgaagagcctgtacaacaccgtgtgcgtgatctggtgcatccacgccgaggagaaggtgaagcacaccgaggaggccaagcagatcgtgcagcgccacctggtggtggagaccggcaccaccgagaccatgcccaagaccagccgcccgaccgcgcccagcagcggacgcggcggcaactacccggtgcagcagatcggcggcaactacgtgcacctgccgctgagcccgcgcaccctgaacgcctgggtgaagctgatcgaggagaagaagttcggcgccgaggtggtgcccggcttccaggccctgagcgagggctgcacgccctacgacatcaaccagatgctgaactgcgtgggcgaccaccaggccgccatgcagatcatccgcgacatcatcaacgaggaggccgccgactgggacctgcagcacccgcagcccgcgccgcagcagggccagctgcgcgagcccagcggcagcgacatcgccggcaccaccagcagcgtggacgagcagatccagtggatgtaccgccagcagaacccgatcccggtgggcaacatctaccgccgctggatacagctgggcctgcagaagtgcgtgcgcatgtacaacccgaccaacatcctggacgtgaagcagggcccgaaggagcccttccagagctacgtggaccgcttctacaagagcctgcgcgccgagcagaccgacgccgccgtgaagaactggatgacccagaccctgctgatccagaacgccaacccggactgcaagctggtgctgaagggcctgggcgtgaacccgaccctggaggagatgctgaccgcctgccagggcgtgggcggcccgggccagaaggcccgcctgatggccgaggccctgaaggaggccctggcgcccgtgcccatcccgttcgcggccgcccagcagcgcggcccgcgcaagcccatcaagtgctggaactgcggcaaggagggccacagcgcccgccagtgccgcgcgccgcgccgccagggctgctggaagtgcggcaagatggaccacgtgatggccaagtgcccggaccgccaggcgggtaggccttggtccatggggaaagaagccgcgcaatttcccgatggctcaagtgcatcaggggctgatgccaactgctccgccagaggacccagctgtggatctgctaaagaactacatgcagttgggcaagcagcagagagaaaagcagagagaaagcagagagaagccttacaaggaggtgacagaggatttgctgcacctcaattctctctttggaggagaccagtagtcactgcatcgatcgagggccagcccgtggaggtgcttctagacaccggcgccgacgacagcatcgtgaccggcatcgagctgggcccgcactacaccccgaagatcgtgggcggcatcggcggcttcatcaacaccggagagtacaagaacgtggagatcgaggtgctgggcaagcgcatcaagggcaccatcatgaccggcgacacgcccatcaacatcttcggccgcaacctgctgaccgccctgggcatgagcctgaacttccccatcgccaaggtggagcccgtgaaggtggccctgaagcccggcaaggacggccccaagctgaagcagtggcccctgagcaaggagaagatcgtggccctgcgcgagatctgcgagaagatggagaaggacggccagctggaggaggccccacccaccaacccctacaacacgcccaccttcgccatcaagaagaaggacaagaacaagtggcgcatgctgatcgacttccgcgagctgaaccgcgtgacccaggacttcaccgaggtgcagctgggcatcccgcaccccgccggcctggccaagcgcaagcgcatcaccgtgctggacatcggcgacgcctacttcagcatccccctggacgaggagttccgccagtacaccgccttcaccctgcccagcgtgaacaacgccgagcccggcaagcgctacatctacaaggtgctgccccagggctggaagggcagccccgccatcttccagtacaccatgcgccacgtgctggagcccttccgcaaggccaaccccgacgtgaccctggtgcagtacatgcatgacatcctgatcgccagcgaccgcaccgacctggagcacgaccgcgtggtgctgcagagcaaggagctgctgaacagcatcggcttcagcacgcccgaggagaagttccagaaggacccacccttccagtggatgggctacgagctgtggcccaccaagtggaagctgcagaagatcgagctgccccagcgcgagacctggaccgtgaacgacatccagaagctggtgggcgtgctgaactgggccgcccagatctaccccggcatcaagaccaagcacctgtgccgcctgatccgcggcaagatgaccctgaccgaggaggtgcagtggaccgagatggccgaggccgagtacgaggagaacaagatcatcctgagccaggagcaggagggctgctactaccaggagggcaagcccctggaggccaccgtgatcaagagccaggacaaccagtggagctacaagatccaccaggaggacaagatcctgaaggtgggcaagttcgccaagatcaagaacacccacaccaacggcgtgcgcctgctggcccacgtgatccagaagatcggcaaggaggccatcgtgatctggggccaggtgcccaagttccacctgcccgtggagaaggacgtgtgggagcagtggtggaccgactactggcaggtgacctggatacccgagtgggacttcatcagcacccctcccctggtgcgcctggtgttcaacctggtgaaggaccccatcgagggcgaggagacctactacaccgacggcagctgcaacaagcagagcaaggagggcaaggccggctacatcaccgaccgcggcaaggacaaggtgaaggtgctggagcagaccaccaaccagcaggccgagctcgaggccttcctgatggccctgaccgacagcggccccaaggccaacatcatcgtggacagccagtacgtgatgggcatcatcaccggctgccccaccgagagcgagagccgcctggtgaaccagatcatcgaggagatgatcaagaagagcgagatctacgtggcctgggtgcccgcccacaagggcatcggcggcaaccaggagatcgaccacctggtgagccagggcatccgccaggtgctgttcctggagaagatcgagcccgcccaggaggagcacgacaagtaccacagcaacgtgaaggagctggtgttcaagttcggcctgccccgcatcgtggcccgccagatcgtggacacctgcgacaagtgccaccagaagggcgaggccatccacggccaggccaacagcgacctgggcacctggcagatggcctgcacccacctggagggcaagatcatcatcgtggccgtgcacgtggccagcggcttcatcgaggccgaggtgatcccgcaggagaccggccgccagaccgccctgttcctgctgaagctggccggccgctggcccatcacccacctgcacaccgacaacggcgccaacttcgccagccaggaggtgaagatggtggcctggtgggccggcatcgagcacaccttcggcgtgccctacaacccgcagagccagggcgtggtggaggccatgaaccaccacctgaagaaccagatcgaccgcatccgcgagcaggccaacagcgtggagaccatcgtgctgatggccgtgcactgcatgaacttcaagcgccgcggcggcatcggcgacatgacgcccgccgagcgcctgatcaacatgatcaccaccgagcaggagatccagttccagcagagcaagaacagcaagttcaagaacttccgcgtgtactaccgcgagggccgcgaccagctgtggaagggccccggcgagctgctgtggaagggcgagggcgccgtgatcctgaaggtgggcaccgacatcaaggtggtgccccgccgcaaggccaagatcatcaaggactacggcggcggcaaggaggtggacagcagcagccacatggaggacaccggcgaggcccgcgaggtggcctgagaattcgtttaaacacgcgtgtatacggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 168 - DNA, 9166 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacatgggcgcccgcgccagcatcctgcgcggcggcaagctggacgcctgggagcgcatcaagctgaagcccggcggcaagaagcactacatgatgaagcacctggtgtgggccagccgcgagctggagcgcttcgccctggaccccggcctgctggagaccagcgagggctgcaagcagatcatgaagcagctgcagcccgccctgcagaccggcaccaaggagctgatcagcctgcacaacaccgtggccaccctgtactgcgtgcacgagaagatcgacgtgcgcgacaccaaggaggccctggacaagatcaaggaggagcagaacaagagccagcagaagacccagcaggccgaggccgccgacaagggcaaggtgagccagaactaccccatcgtgcagaacctgcagggccagatggtgcaccagcccatcagcgcccgcaccctgaacgcctgggtgaaggtggtggaggagaaggccttcagccccgaggtgatccccatgttcaccgccctgagcgagggcgccaccccccaggacctgaacaccatgctgaacaccgtgggcggccaccaggccgccatgcagatgctgaaggacaccatcaacgaggaggccgccgagtgggaccgcctgcaccccgtgcacgccggccccgtggcccccggccagatgcgcgagccccgcggcagcgacatcgccggcaccaccagcaccctgcaggagcagatcacctggatgaccaacaacccccccgtgcccgtgggcgacatctacaagcgctggatcatcctgggcctgaacaagatcgtgcgcatgtacagccccgtgagcatcctggacatcaagcagggccccaaggagcccttccgcgactacgtggaccgcttcttcaagaccctgcgcgccgagcaggccacccaggacgtgaagaactggatgaccgacaccctgctggtgcagaacgccaaccccgactgcaagaccatcctgcgcgccctgggccccggcgccagcctggaggagatgatgaccgcctgccagggcgtgggcggccccggccacaaggcccgcgtgctggccgaggccatgagcaaggtgaacaacaccaacatcatgatgcagcgcagcaactgcaagggccccaagcgcaccatcaagtgcttcaactgcggcaaggagggccacctggcccgcaactgccgcgccccccgcaagaagggctgctggaagtgcggcaaggagggccaccaggtgaaggactgcaccgagcgacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagatagggggccagctgaaggaggcccttctagacaccggcgccgacgacaccgtgctggaggagatgaacctgcccggccgctggaagcccaagatgatcggcggcatcggcggcttcatcaaggtgggccagtacgaccagatcctgatcgagatctgcggccacaaggccatcggcaccgtgctggtgggccccacccccgtgaacatcatcggccgcaacctgctgacccagatcggctgcaccctgaacttccccatcagccccatcgagaccgtgcccgtgaagctgaagcccggcatggacggccccaaggtgaagcagtggcccctgaccgaggagaagatcaaggccctggtggagatctgcaccgagatggagaaggagggcaagatcagcaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagcagaagaagagcgtgaccgtgctggacgtgggcgacgcctacttcagcgtgcccctggacaaggacttccgcaagtacaccgccttcaccatccccagcatcaacaacgagacccccggcatccgctaccagtacaacgtgctgccccagggctggaagggcagccccgccatcttccagtgcagcatgaccaagatcctggagcccttccgcaagcagaaccccgacatcgtgatctaccagtacatggaccacctgtacgtgggcagcgacctggagatcggccagcaccgcaccaagatcgaggagctgcgccagcacctgctgcgctggggcttcaccacccccgacaagaagcaccagaaggagccccccttcctgtggatgggctacgagctgcaccccgacaagtggaccgtgcagcccatcgtgctgcccgagaaggacagctggaccgtgaacgacatccagaagctggtgggcaagctgaactgggccagccagatctacgccggcatcaaggtgcgccagctgtgcaagctgctgcgcggcaccaaggccctgaccgaggtggtgcccctgaccgaggaggccgagctggagctggccgagaaccgcgagatcctgaaggagcccgtgcacggcgtgtactacgaccccagcaaggacctgatcgccgagatccagaagcagggccagggccagtggacctaccagatctaccaggagcccttcaagaacctgaagaccggcaagtacgcccgcatgaagggcgcccacaccaacgacgtgaagcagctgaccgaggccgtgcagaagatcgccaccgagagcatcgtgatctggggcaagacccccaagttcaagctgcccatccagaaggagacctgggaggcctggtggaccgagtactggcaggccacctggatccccgagtgggagttcgtgaacaccccccccctggtgaagctgtggtaccagctggagaaggagcccatcatcggcgccgagaccttctacgtggacggcgccgccaaccgcgagaccaagctgggcaaggccggctacgtgaccgaccgcggccgccagaaggtggtgcccctgaccgacaccaccaaccagaagaccgagctgcaggccatccacctggccctgcaggacagcggcctggaggtgaacatcgtgaccgacagccagtacgccctgggcatcatccaggcccagcccgacaagagcgagagcgagctggtgagccagatcatcgagcagctgatcaagaaggagaaggtgtacctggcctgggtgcccgcccacaagggcatcggcggcaacgagcaggtggacggcctggtgagcgccggcatccgcaaggtgctgttcctggacggcatcgacaaggcccaggaggagcacgagaagtaccacagcaactggcgcgccatggccagcgacttcaacctgccccccgtggtggccaaggagatcgtggccagctgcgacaagtgccagctgaagggcgaggccatgcacggccaggtggactgcagccccggcatctggcagctggcatgcacccacctggagggcaaggtgatcctggtggccgtgcacgtggccagcggctacatcgaggccgaggtgatccccgccgagaccggccaggagaccgcctacttcctgctgaagctggccggccgctggcccgtgaagaccgtgcacaccgacaacggcagcaacttcaccagcaccaccgtgaaggccgcctgctggtgggccggcatcaagcaggagttcggcatcccctacaacccccagagccagggcgtgatcgagagcatgaacaaggagctgaagaagatcatcggccaggtgcgcgaccaggccgagcacctgaagaccgccgtgcagatggccgtgttcatccacaacttcaagcgcaagggcggcatcggcggctacagcgccggcgagcgcatcgtggacatcatcgccaccgacatccagaccaaggagctgcagaagcagatcaccaagatccagaacttccgcgtgtactaccgcgacagccgcgaccccgtgtggaagggccccgccaagctgctgtggaagggcgagggcgccgtggtgatccaggacaacagcgacatcaaggtggtgccccgccgcaaggccaagatcatccgcgactacggcaagcagatggccggcgacgactgcgtggccagccgccaggacgaggactaggaattcttgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaatttcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 169 - DNA, 9169 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacatgggcgcccgcgccagcgtgctgagcggcggcaagttcgacgcctgggagaagatccgcctgcgccccggcggcaagaagaagtaccgcatgaagcacctgatctgggccagccgcgagctggaccgcttcgccctgaaccccagcctgctggagaccgccgacggctgccagcagatcatggagaagctgcagcccgccctgaagaccggcaccgaggagatcaagagcctgttcaacaccgtggccaccctgtactgcgtgcaccagcgcatcgacgtgaaggacaccaaggaggccctggacaagatcgaggagatcaagaacaagagcaagcagaagacccagcaggccgccgccgacaccggcaacagcagcaacgtgagccagaactaccccatcgtgcagaacgcccagggccagatgatccaccagagcctgagcccccgcaccctgaacgcctgggtgaaggtgatcgaggagaaggccttcagccccgaggtgatccccatgttcagcgccctgagcgagggcgccaccccccaggacctgaacatgatgctgaacatcgtgggcggccaccaggccgccatgcagatgctgaaggacaccatcaacgaggaggccgccgagtgggaccgcctgcaccccgtgcacgccggccccatcccccccggccagatgcgcgagccccgcggcagcgacatcgccggcaccaccagcaccccccaggagcagatcggctggatgaccggcaacccccccatccccgtgggcgacatctacaagcgctggatcatcctgggcctgaacaagatcgtgcgcatgtacagccccgtgagcatcctggacatcaagcagggccccaaggagcccttccgcgactacgtggaccgcttcttcaagaccttccgcgccgagcaggccacccaggacgtgaagaactggatgaccgacaccctgctggtgcagaacgccaaccccgactgcaaggccatcctgcgcgccctgggccccggcgccaccctggaggagatgatgaccgcctgccagggcgtgggcggccccggccacaaggcccgcgtgctggccgaggccatgagccaggtgcagcacaccaacatcatgatgcagcgcggcaacttcaagggccagaagcgcatcaagtgcttcaactgcggcaaggagggccacctggcccgcaactgccgcgccctgcgcaagaagggctgctggaagtgcggcaaggagggccaccagatgaaggactgcaccgagcgacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagatagggggccagctgaaggaggcccttctagacaccggcgccgacgacaccgtgctggaggagatgaacctgcccggccgctggaagcccaagatgatcggcggcatcggcggcttcatcaaggtgggccagtacgaccagatcctgatcgagatctgcggccacaaggccatcggcaccgtgctggtgggccccacccccgtgaacatcatcggccgcaacctgctgacccagatcggctgcaccctgaacttccccatcagccccatcgagaccgtgcccgtgaagctgaagcccggcatggacggccccaaggtgaagcagtggcccctgaccgaggagaagatcaaggccctggtggagatctgcaccgagatggagaaggagggcaagatcagcaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagcagaagaagagcgtgaccgtgctggacgtgggcgacgcctacttcagcgtgcccctggacaaggacttccgcaagtacaccgccttcaccatccccagcatcaacaacgagacccccggcatccgctaccagtacaacgtgctgccccagggctggaagggcagccccgccatcttccagtgcagcatgaccaagatcctggagcccttccgcaagcagaaccccgacatcgtgatctaccagtacatggaccacctgtacgtgggcagcgacctggagatcggccagcaccgcaccaagatcgaggagctgcgccagcacctgctgcgctggggcttcaccacccccgacaagaagcaccagaaggagccccccttcctgtggatgggctacgagctgcaccccgacaagtggaccgtgcagcccatcgtgctgcccgagaaggacagctggaccgtgaacgacatccagaagctggtgggcaagctgaactgggccagccagatctacgccggcatcaaggtgcgccagctgtgcaagctgctgcgcggcaccaaggccctgaccgaggtggtgcccctgaccgaggaggccgagctggagctggccgagaaccgcgagatcctgaaggagcccgtgcacggcgtgtactacgaccccagcaaggacctgatcgccgagatccagaagcagggccagggccagtggacctaccagatctaccaggagcccttcaagaacctgaagaccggcaagtacgcccgcatgaagggcgcccacaccaacgacgtgaagcagctgaccgaggccgtgcagaagatcgccaccgagagcatcgtgatctggggcaagacccccaagttcaagctgcccatccagaaggagacctgggaggcctggtggaccgagtactggcaggccacctggatccccgagtgggagttcgtgaacaccccccccctggtgaagctgtggtaccagctggagaaggagcccatcatcggcgccgagaccttctacgtggacggcgccgccaaccgcgagaccaagctgggcaaggccggctacgtgaccgaccgcggccgccagaaggtggtgcccctgaccgacaccaccaaccagaagaccgagctgcaggccatccacctggccctgcaggacagcggcctggaggtgaacatcgtgaccgacagccagtacgccctgggcatcatccaggcccagcccgacaagagcgagagcgagctggtgagccagatcatcgagcagctgatcaagaaggagaaggtgtacctggcctgggtgcccgcccacaagggcatcggcggcaacgagcaggtggacggcctggtgagcgccggcatccgcaaggtgctgttcctggacggcatcgacaaggcccaggaggagcacgagaagtaccacagcaactggcgcgccatggccagcgacttcaacctgccccccgtggtggccaaggagatcgtggccagctgcgacaagtgccagctgaagggcgaggccatgcacggccaggtggactgcagccccggcatctggcagctggcatgcacccacctggagggcaaggtgatcctggtggccgtgcacgtggccagcggctacatcgaggccgaggtgatccccgccgagaccggccaggagaccgcctacttcctgctgaagctggccggccgctggcccgtgaagaccgtgcacaccgacaacggcagcaacttcaccagcaccaccgtgaaggccgcctgctggtgggccggcatcaagcaggagttcggcatcccctacaacccccagagccagggcgtgatcgagagcatgaacaaggagctgaagaagatcatcggccaggtgcgcgaccaggccgagcacctgaagaccgccgtgcagatggccgtgttcatccacaacttcaagcgcaagggcggcatcggcggctacagcgccggcgagcgcatcgtggacatcatcgccaccgacatccagaccaaggagctgcagaagcagatcaccaagatccagaacttccgcgtgtactaccgcgacagccgcgaccccgtgtggaagggccccgccaagctgctgtggaagggcgagggcgccgtggtgatccaggacaacagcgacatcaaggtggtgccccgccgcaaggccaagatcatccgcgactacggcaagcagatggccggcgacgactgcgtggccagccgccaggacgaggactaggaattcttgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaatttcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 170 - DNA, 9792 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacatgggcgcccgcgccagcgtgctgagcggcggcgagctggaccgctgggagaagatccgcctgcgccccggcggcaagaagaagtacaagctgaagcacatcgtgtgggccagccgcgagctggagcgcttcgccgtgaaccccggcctgctggagaccagcgagggctgccgccagatcctgggccagctgcagcccagcctgcagaccggcagcgaggagctgcgcagcctgtacaacaccgtggccaccctgtactgcgtgcaccagcgcatcgagatcaaggacaccaaggaggccctggacaagatcgaggaggagcagaacaagagcaagaagaaggcccagcaggccgccgccgacaccggccacagcaaccaggtgagccagaactaccccatcgtgcagaacatccagggccagatggtgcaccaggccatcagcccccgcaccctgaacgcctgggtgaaggtggtggaggagaaggccttcagccccgaggtgatccccatgttcagcgccctgagcgagggcgccaccccccaggacctgaacaccatgctgaacaccgtgggcggccaccaggccgccatgcagatgctgaaggagaccatcaacgaggaggccgccgagtgggaccgcgtgcaccccgtgcacgccggccccatcgcccccggccagatgcgcgagccccgcggcagcgacatcgccggcaccaccagcaccctgcaggagcagatcggctggatgaccaacaacccccccatccccgtgggcgagatctacaagcgctggatcatcctgggcctgaacaagatcgtgcgcatgtacagccccaccagcatcctggacatccgccagggccccaaggagcccttccgcgactacgtggaccgcttctacaagaccctgcgcgccgagcaggccagccaggaggtgaagaactggatgaccgagaccctgctggtgcagaacgccaaccccgactgcaagaccatcctgaaggccctgggccccgccgccaccctggaggagatgatgaccgcctgccagggcgtgggcggccccggccacaaggcccgcgtgctggccgaggccatgagccaggtgaccaacagcgccaccatcatgatgcagcgcggcaacttccgcaaccagcgcaagatcgtgaagtgcttcaactgcggcaaggagggccacaccgcccgcaactgccgcgccccccgcaagaagggctgctggaagtgcggcaaggagggccaccagatgaaggactgcaccgagcgacaggctaatagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagatagggggccagctgaaggaggcccttctagacaccggcgccgacgacaccgtgctggaggagatgaacctgcccggccgctggaagcccaagatgatcggcggcatcggcggcttcatcaaggtgggccagtacgaccagatcctgatcgagatctgcggccacaaggccatcggcaccgtgctggtgggccccacccccgtgaacatcatcggccgcaacctgctgacccagatcggctgcaccctgaacttccccatcagccccatcgagaccgtgcccgtgaagctgaagcccggcatggacggccccaaggtgaagcagtggcccctgaccgaggagaagatcaaggccctggtggagatctgcaccgagatggagaaggagggcaagatcagcaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagcagaagaagagcgtgaccgtgctggacgtgggcgacgcctacttcagcgtgcccctggacaaggacttccgcaagtacaccgccttcaccatccccagcatcaacaacgagacccccggcatccgctaccagtacaacgtgctgccccagggctggaagggcagccccgccatcttccagtgcagcatgaccaagatcctggagcccttccgcaagcagaaccccgacatcgtgatctaccagtacatggaccacctgtacgtgggcagcgacctggagatcggccagcaccgcaccaagatcgaggagctgcgccagcacctgctgcgctggggcttcaccacccccgacaagaagcaccagaaggagccccccttcctgtggatgggctacgagctgcaccccgacaagtggaccgtgcagcccatcgtgctgcccgagaaggacagctggaccgtgaacgacatccagaagctggtgggcaagctgaactgggccagccagatctacgccggcatcaaggtgcgccagctgtgcaagctgctgcgcggcaccaaggccctgaccgaggtggtgcccctgaccgaggaggccgagctggagctggccgagaaccgcgagatcctgaaggagcccgtgcacggcgtgtactacgaccccagcaaggacctgatcgccgagatccagaagcagggccagggccagtggacctaccagatctaccaggagcccttcaagaacctgaagaccggcaagtacgcccgcatgaagggcgcccacaccaacgacgtgaagcagctgaccgaggccgtgcagaagatcgccaccgagagcatcgtgatctggggcaagacccccaagttcaagctgcccatccagaaggagacctgggaggcctggtggaccgagtactggcaggccacctggatccccgagtgggagttcgtgaacaccccccccctggtgaagctgtggtaccagctggagaaggagcccatcatcggcgccgagaccttctacgtggacggcgccgccaaccgcgagaccaagctgggcaaggccggctacgtgaccgaccgcggccgccagaaggtggtgcccctgaccgacaccaccaaccagaagaccgagctgcaggccatccacctggccctgcaggacagcggcctggaggtgaacatcgtgaccgacagccagtacgccctgggcatcatccaggcccagcccgacaagagcgagagcgagctggtgagccagatcatcgagcagctgatcaagaaggagaaggtgtacctggcctgggtgcccgcccacaagggcatcggcggcaacgagcaggtggacggcctggtgagcgccggcatccgcaaggtgctgttcctggacggcatcgacaaggcccaggaggagcacgagaagtaccacagcaactggcgcgccatggccagcgacttcaacctgccccccgtggtggccaaggagatcgtggccagctgcgacaagtgccagctgaagggcgaggccatgcacggccaggtggactgcagccccggcatctggcagctggcatgcacccacctggagggcaaggtgatcctggtggccgtgcacgtggccagcggctacatcgaggccgaggtgatccccgccgagaccggccaggagaccgcctacttcctgctgaagctggccggccgctggcccgtgaagaccgtgcacaccgacaacggcagcaacttcaccagcaccaccgtgaaggccgcctgctggtgggccggcatcaagcaggagttcggcatcccctacaacccccagagccagggcgtgatcgagagcatgaacaaggagctgaagaagatcatcggccaggtgcgcgaccaggccgagcacctgaagaccgccgtgcagatggccgtgttcatccacaacttcaagcgcaagggcggcatcggcggctacagcgccggcgagcgcatcgtggacatcatcgccaccgacatccagaccaaggagctgcagaagcagatcaccaagatccagaacttccgcgtgtactaccgcgacagccgcgaccccgtgtggaagggccccgccaagctgctgtggaagggcgagggcgccgtggtgatccaggacaacagcgacatcaaggtggtgccccgccgcaaggccaagatcatccgcgactacggcaagcagatggccggcgacgactgcgtggccagccgccaggacgaggacatgggcggcaagtggagcaagagcagcgtgatcggctggcccgccgtgcgcgagcgcatgcgccgcgccgagcccgccgccgacggcgtgggcgccgtgagccgcgacctggagaagcacggcgccatcaccagcagcaacaccgccgccaacaacgccgcctgcgcctggctggaggcccaggaggaggaggaggtgggcttccccgtgaccccccaggtgcccctgcgccccatgacctacaaggccgccgtggacctgagccacttcctgaaggagaagggcggcctggagggcctgatccacagccagcgccgccaggacatcctggacctgtggatctaccacacccagggctacttccccgactggcagaactacacccccggccccggcgtgcgctaccccctgaccttcggctggtgctacaagctggtgcccgtggagcccgacaaggtggaggaggccaacaagggcgagaacaccagcctgctgcaccccgtgagcctgcacggcatggacgaccccgagcgcgaggtgctggagtggcgcttcgacagccgcctggccttccaccacgtggcccgcgagctgcaccccgagtacttcaagaactgctgaggatcaattcttgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaatttcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 171 - DNA, 9167 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacatggcccgcgccagcgtgctgagcggcggcgagctggaccgctgggagaagatccgcctgcgccccggcggcaagaagaagtacaagctgaagcacatcgtgtgggccagccgcgagctggagcgcttcgccgtgaaccccggcctgctggagaccagcgagggctgccgccagatcctgggccagctgcagcccagcctgcagaccggcagcgaggagctgcgcagcctgtacaacaccgtggccaccctgtactgcgtgcaccagcgcatcgagatcaaggacaccaaggaggccctggacaagatcgaggaggagcagaacaagagcaagaagaaggcccagcaggccgccgccgacaccggccacagcaaccaggtgagccagaactaccccatcgtgcagaacatccagggccagatggtgcaccaggccatcagcccccgcaccctgaacgcctgggtgaaggtggtggaggagaaggccttcagccccgaggtgatccccatgttcagcgccctgagcgagggcgccaccccccaggacctgaacaccatgctgaacaccgtgggcggccaccaggccgccatgcagatgctgaaggagaccatcaacgaggaggccgccgagtgggaccgcgtgcaccccgtgcacgccggccccatcgcccccggccagatgcgcgagccccgcggcagcgacatcgccggcaccaccagcaccctgcaggagcagatcggctggatgaccaacaacccccccatccccgtgggcgagatctacaagcgctggatcatcctgggcctgaacaagatcgtgcgcatgtacagccccaccagcatcctggacatccgccagggccccaaggagcccttccgcgactacgtggaccgcttctacaagaccctgcgcgccgagcaggccagccaggaggtgaagaactggatgaccgagaccctgctggtgcagaacgccaaccccgactgcaagaccatcctgaaggccctgggccccgccgccaccctggaggagatgatgaccgcctgccagggcgtgggcggccccggccacaaggcccgcgtgctggccgaggccatgagccaggtgaccaacagcgccaccatcatgatgcagcgcggcaacttccgcaaccagcgcaagatcgtgaagtgcttcaactgcggcaaggagggccacaccgcccgcaactgccgcgccccccgcaagaagggctgctggaagtgcggcaaggagggccaccagatgaaggactgcaccgagcgacaggctaatagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagatagggggccagctgaaggaggcccttctagacaccggcgccgacgacaccgtgctggaggagatgaacctgcccggccgctggaagcccaagatgatcggcggcatcggcggcttcatcaaggtgggccagtacgaccagatcctgatcgagatctgcggccacaaggccatcggcaccgtgctggtgggccccacccccgtgaacatcatcggccgcaacctgctgacccagatcggctgcaccctgaacttccccatcagccccatcgagaccgtgcccgtgaagctgaagcccggcatggacggccccaaggtgaagcagtggcccctgaccgaggagaagatcaaggccctggtggagatctgcaccgagatggagaaggagggcaagatcagcaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagcagaagaagagcgtgaccgtgctggacgtgggcgacgcctacttcagcgtgcccctggacaaggacttccgcaagtacaccgccttcaccatccccagcatcaacaacgagacccccggcatccgctaccagtacaacgtgctgccccagggctggaagggcagccccgccatcttccagtgcagcatgaccaagatcctggagcccttccgcaagcagaaccccgacatcgtgatctaccagtacatggaccacctgtacgtgggcagcgacctggagatcggccagcaccgcaccaagatcgaggagctgcgccagcacctgctgcgctggggcttcaccacccccgacaagaagcaccagaaggagccccccttcctgtggatgggctacgagctgcaccccgacaagtggaccgtgcagcccatcgtgctgcccgagaaggacagctggaccgtgaacgacatccagaagctggtgggcaagctgaactgggccagccagatctacgccggcatcaaggtgcgccagctgtgcaagctgctgcgcggcaccaaggccctgaccgaggtggtgcccctgaccgaggaggccgagctggagctggccgagaaccgcgagatcctgaaggagcccgtgcacggcgtgtactacgaccccagcaaggacctgatcgccgagatccagaagcagggccagggccagtggacctaccagatctaccaggagcccttcaagaacctgaagaccggcaagtacgcccgcatgaagggcgcccacaccaacgacgtgaagcagctgaccgaggccgtgcagaagatcgccaccgagagcatcgtgatctggggcaagacccccaagttcaagctgcccatccagaaggagacctgggaggcctggtggaccgagtactggcaggccacctggatccccgagtgggagttcgtgaacaccccccccctggtgaagctgtggtaccagctggagaaggagcccatcatcggcgccgagaccttctacgtggacggcgccgccaaccgcgagaccaagctgggcaaggccggctacgtgaccgaccgcggccgccagaaggtggtgcccctgaccgacaccaccaaccagaagaccgagctgcaggccatccacctggccctgcaggacagcggcctggaggtgaacatcgtgaccgacagccagtacgccctgggcatcatccaggcccagcccgacaagagcgagagcgagctggtgagccagatcatcgagcagctgatcaagaaggagaaggtgtacctggcctgggtgcccgcccacaagggcatcggcggcaacgagcaggtggacggcctggtgagcgccggcatccgcaaggtgctgttcctggacggcatcgacaaggcccaggaggagcacgagaagtaccacagcaactggcgcgccatggccagcgacttcaacctgccccccgtggtggccaaggagatcgtggccagctgcgacaagtgccagctgaagggcgaggccatgcacggccaggtggactgcagccccggcatctggcagctggcatgcacccacctggagggcaaggtgatcctggtggccgtgcacgtggccagcggctacatcgaggccgaggtgatccccgccgagaccggccaggagaccgcctacttcctgctgaagctggccggccgctggcccgtgaagaccgtgcacaccgacaacggcagcaacttcaccagcaccaccgtgaaggccgcctgctggtgggccggcatcaagcaggagttcggcatcccctacaacccccagagccagggcgtgatcgagagcatgaacaaggagctgaagaagatcatcggccaggtgcgcgaccaggccgagcacctgaagaccgccgtgcagatggccgtgttcatccacaacttcaagcgcaagggcggcatcggcggctacagcgccggcgagcgcatcgtggacatcatcgccaccgacatccagaccaaggagctgcagaagcagatcaccaagatccagaacttccgcgtgtactaccgcgacagccgcgaccccgtgtggaagggccccgccaagctgctgtggaagggcgagggcgccgtggtgatccaggacaacagcgacatcaaggtggtgccccgccgcaaggccaagatcatccgcgactacggcaagcagatggccggcgacgactgcgtggccagccgccaggacgaggactaggaattcttgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaatttcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 172 - DNA, 9783 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacatggcccgcgccagcgtgctgagcggcggcgagctggaccgctgggagaagatccgcctgcgccccggcggcaagaagaagtacaagctgaagcacatcgtgtgggccagccgcgagctggagcgcttcgccgtgaaccccggcctgctggagaccagcgagggctgccgccagatcctgggccagctgcagcccagcctgcagaccggcagcgaggagctgcgcagcctgtacaacaccgtggccaccctgtactgcgtgcaccagcgcatcgagatcaaggacaccaaggaggccctggacaagatcgaggaggagcagaacaagagcaagaagaaggcccagcaggccgccgccgacaccggccacagcaaccaggtgagccagaactaccccatcgtgcagaacatccagggccagatggtgcaccaggccatcagcccccgcaccctgaacgcctgggtgaaggtggtggaggagaaggccttcagccccgaggtgatccccatgttcagcgccctgagcgagggcgccaccccccaggacctgaacaccatgctgaacaccgtgggcggccaccaggccgccatgcagatgctgaaggagaccatcaacgaggaggccgccgagtgggaccgcgtgcaccccgtgcacgccggccccatcgcccccggccagatgcgcgagccccgcggcagcgacatcgccggcaccaccagcaccctgcaggagcagatcggctggatgaccaacaacccccccatccccgtgggcgagatctacaagcgctggatcatcctgggcctgaacaagatcgtgcgcatgtacagccccaccagcatcctggacatccgccagggccccaaggagcccttccgcgactacgtggaccgcttctacaagaccctgcgcgccgagcaggccagccaggaggtgaagaactggatgaccgagaccctgctggtgcagaacgccaaccccgactgcaagaccatcctgaaggccctgggccccgccgccaccctggaggagatgatgaccgcctgccagggcgtgggcggccccggccacaaggcccgcgtgctggccgaggccatgagccaggtgaccaacagcgccaccatcatgatgcagcgcggcaacttccgcaaccagcgcaagatcgtgaagtgcttcaactgcggcaaggagggccacaccgcccgcaactgccgcgccccccgcaagaagggctgctggaagtgcggcaaggagggccaccagatgaaggactgcaccgagcgacaggctaatagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagatagggggccagctgaaggaggcccttctagacaccggcgccgacgacaccgtgctggaggagatgaacctgcccggccgctggaagcccaagatgatcggcggcatcggcggcttcatcaaggtgggccagtacgaccagatcctgatcgagatctgcggccacaaggccatcggcaccgtgctggtgggccccacccccgtgaacatcatcggccgcaacctgctgacccagatcggctgcaccctgaacttccccatcagccccatcgagaccgtgcccgtgaagctgaagcccggcatggacggccccaaggtgaagcagtggcccctgaccgaggagaagatcaaggccctggtggagatctgcaccgagatggagaaggagggcaagatcagcaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagcagaagaagagcgtgaccgtgctggacgtgggcgacgcctacttcagcgtgcccctggacaaggacttccgcaagtacaccgccttcaccatccccagcatcaacaacgagacccccggcatccgctaccagtacaacgtgctgccccagggctggaagggcagccccgccatcttccagtgcagcatgaccaagatcctggagcccttccgcaagcagaaccccgacatcgtgatctaccagtacatggaccacctgtacgtgggcagcgacctggagatcggccagcaccgcaccaagatcgaggagctgcgccagcacctgctgcgctggggcttcaccacccccgacaagaagcaccagaaggagccccccttcctgtggatgggctacgagctgcaccccgacaagtggaccgtgcagcccatcgtgctgcccgagaaggacagctggaccgtgaacgacatccagaagctggtgggcaagctgaactgggccagccagatctacgccggcatcaaggtgcgccagctgtgcaagctgctgcgcggcaccaaggccctgaccgaggtggtgcccctgaccgaggaggccgagctggagctggccgagaaccgcgagatcctgaaggagcccgtgcacggcgtgtactacgaccccagcaaggacctgatcgccgagatccagaagcagggccagggccagtggacctaccagatctaccaggagcccttcaagaacctgaagaccggcaagtacgcccgcatgaagggcgcccacaccaacgacgtgaagcagctgaccgaggccgtgcagaagatcgccaccgagagcatcgtgatctggggcaagacccccaagttcaagctgcccatccagaaggagacctgggaggcctggtggaccgagtactggcaggccacctggatccccgagtgggagttcgtgaacaccccccccctggtgaagctgtggtaccagctggagaaggagcccatcatcggcgccgagaccttctacgtggacggcgccgccaaccgcgagaccaagctgggcaaggccggctacgtgaccgaccgcggccgccagaaggtggtgcccctgaccgacaccaccaaccagaagaccgagctgcaggccatccacctggccctgcaggacagcggcctggaggtgaacatcgtgaccgacagccagtacgccctgggcatcatccaggcccagcccgacaagagcgagagcgagctggtgagccagatcatcgagcagctgatcaagaaggagaaggtgtacctggcctgggtgcccgcccacaagggcatcggcggcaacgagcaggtggacggcctggtgagcgccggcatccgcaaggtgctgttcctggacggcatcgacaaggcccaggaggagcacgagaagtaccacagcaactggcgcgccatggccagcgacttcaacctgccccccgtggtggccaaggagatcgtggccagctgcgacaagtgccagctgaagggcgaggccatgcacggccaggtggactgcagccccggcatctggcagctggcatgcacccacctggagggcaaggtgatcctggtggccgtgcacgtggccagcggctacatcgaggccgaggtgatccccgccgagaccggccaggagaccgcctacttcctgctgaagctggccggccgctggcccgtgaagaccgtgcacaccgacaacggcagcaacttcaccagcaccaccgtgaaggccgcctgctggtgggccggcatcaagcaggagttcggcatcccctacaacccccagagccagggcgtgatcgagagcatgaacaaggagctgaagaagatcatcggccaggtgcgcgaccaggccgagcacctgaagaccgccgtgcagatggccgtgttcatccacaacttcaagcgcaagggcggcatcggcggctacagcgccggcgagcgcatcgtggacatcatcgccaccgacatccagaccaaggagctgcagaagcagatcaccaagatccagaacttccgcgtgtactaccgcgacagccgcgaccccgtgtggaagggccccgccaagctgctgtggaagggcgagggcgccgtggtgatccaggacaacagcgacatcaaggtggtgccccgccgcaaggccaagatcatccgcgactacggcaagcagatggccggcgacgactgcgtggccagccgccaggacgaggacatgggcggcaagtggagcaagagcagcgtgatcggctggcccgccgtgcgcgagcgcatgcgccgcgccgagcccgccgccgacggcgtgggcgccgtgagccgcgacctggagaagcacggcgccatcaccagcagcaacaccgccgccaacaacgccgcctgcgcctggctggaggcccaggaggaggaggaggtgggcttccccgtgaccccccaggtgcccctgcgccccatgacctacaaggccgccgtggacctgagccacttcctgaaggagaagggcggcctggagggcctgatccacagccagcgccgccaggacatcctggacctgtggatctaccacacccagggctacttccccgactggcagaactacacccccggccccggcgtgcgctaccccctgaccttcggctggtgctacaagctggtgcccgtggagcccgacaaggtggaggaggccaacaagggcgagaacaccagcctgctgcaccccgtgagcctgcacggcatggacgaccccgagcgcgaggtgctggagtggcgcttcgacagccgcctggccttccaccacgtggcccgcgagctgcaccccgagtacttcaagaactgctgaggatcaattcttgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaatttcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 173 - DNA, 9782 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacatggcaaagtggagcaagagcagcgtgatcggctggcccgccgtgcgcgagcgcatgcgccgcgccgagcccgccgccgacggcgtgggcgccgtgagccgcgacctggagaagcacggcgccatcaccagcagcaacaccgccgccaacaacgccgcctgcgcctggctggaggcccaggaggaggaggaggtgggcttccccgtgaccccccaggtgcccctgcgccccatgacctacaaggccgccgtggacctgagccacttcctgaaggagaagggcggcctggagggcctgatccacagccagcgccgccaggacatcctggacctgtggatctaccacacccagggctacttccccgactggcagaactacacccccggccccggcgtgcgctaccccctgaccttcggctggtgctacaagctggtgcccgtggagcccgacaaggtggaggaggccaacaagggcgagaacaccagcctgctgcaccccgtgagcctgcacggcatggacgaccccgagcgcgaggtgctggagtggcgcttcgacagccgcctggccttccaccacgtggcccgcgagctgcaccccgagtacttcaagaactgcatggcccgcgccagcgtgctgagcggcggcgagctggaccgctgggagaagatccgcctgcgccccggcggcaagaagaagtacaagctgaagcacatcgtgtgggccagccgcgagctggagcgcttcgccgtgaaccccggcctgctggagaccagcgagggctgccgccagatcctgggccagctgcagcccagcctgcagaccggcagcgaggagctgcgcagcctgtacaacaccgtggccaccctgtactgcgtgcaccagcgcatcgagatcaaggacaccaaggaggccctggacaagatcgaggaggagcagaacaagagcaagaagaaggcccagcaggccgccgccgacaccggccacagcaaccaggtgagccagaactaccccatcgtgcagaacatccagggccagatggtgcaccaggccatcagcccccgcaccctgaacgcctgggtgaaggtggtggaggagaaggccttcagccccgaggtgatccccatgttcagcgccctgagcgagggcgccaccccccaggacctgaacaccatgctgaacaccgtgggcggccaccaggccgccatgcagatgctgaaggagaccatcaacgaggaggccgccgagtgggaccgcgtgcaccccgtgcacgccggccccatcgcccccggccagatgcgcgagccccgcggcagcgacatcgccggcaccaccagcaccctgcaggagcagatcggctggatgaccaacaacccccccatccccgtgggcgagatctacaagcgctggatcatcctgggcctgaacaagatcgtgcgcatgtacagccccaccagcatcctggacatccgccagggccccaaggagcccttccgcgactacgtggaccgcttctacaagaccctgcgcgccgagcaggccagccaggaggtgaagaactggatgaccgagaccctgctggtgcagaacgccaaccccgactgcaagaccatcctgaaggccctgggccccgccgccaccctggaggagatgatgaccgcctgccagggcgtgggcggccccggccacaaggcccgcgtgctggccgaggccatgagccaggtgaccaacagcgccaccatcatgatgcagcgcggcaacttccgcaaccagcgcaagatcgtgaagtgcttcaactgcggcaaggagggccacaccgcccgcaactgccgcgccccccgcaagaagggctgctggaagtgcggcaaggagggccaccagatgaaggactgcaccgagcgacaggctaatagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagatagggggccagctgaaggaggcccttctagacaccggcgccgacgacaccgtgctggaggagatgaacctgcccggccgctggaagcccaagatgatcggcggcatcggcggcttcatcaaggtgggccagtacgaccagatcctgatcgagatctgcggccacaaggccatcggcaccgtgctggtgggccccacccccgtgaacatcatcggccgcaacctgctgacccagatcggctgcaccctgaacttccccatcagccccatcgagaccgtgcccgtgaagctgaagcccggcatggacggccccaaggtgaagcagtggcccctgaccgaggagaagatcaaggccctggtggagatctgcaccgagatggagaaggagggcaagatcagcaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagcagaagaagagcgtgaccgtgctggacgtgggcgacgcctacttcagcgtgcccctggacaaggacttccgcaagtacaccgccttcaccatccccagcatcaacaacgagacccccggcatccgctaccagtacaacgtgctgccccagggctggaagggcagccccgccatcttccagtgcagcatgaccaagatcctggagcccttccgcaagcagaaccccgacatcgtgatctaccagtacatggaccacctgtacgtgggcagcgacctggagatcggccagcaccgcaccaagatcgaggagctgcgccagcacctgctgcgctggggcttcaccacccccgacaagaagcaccagaaggagccccccttcctgtggatgggctacgagctgcaccccgacaagtggaccgtgcagcccatcgtgctgcccgagaaggacagctggaccgtgaacgacatccagaagctggtgggcaagctgaactgggccagccagatctacgccggcatcaaggtgcgccagctgtgcaagctgctgcgcggcaccaaggccctgaccgaggtggtgcccctgaccgaggaggccgagctggagctggccgagaaccgcgagatcctgaaggagcccgtgcacggcgtgtactacgaccccagcaaggacctgatcgccgagatccagaagcagggccagggccagtggacctaccagatctaccaggagcccttcaagaacctgaagaccggcaagtacgcccgcatgaagggcgcccacaccaacgacgtgaagcagctgaccgaggccgtgcagaagatcgccaccgagagcatcgtgatctggggcaagacccccaagttcaagctgcccatccagaaggagacctgggaggcctggtggaccgagtactggcaggccacctggatccccgagtgggagttcgtgaacaccccccccctggtgaagctgtggtaccagctggagaaggagcccatcatcggcgccgagaccttctacgtggacggcgccgccaaccgcgagaccaagctgggcaaggccggctacgtgaccgaccgcggccgccagaaggtggtgcccctgaccgacaccaccaaccagaagaccgagctgcaggccatccacctggccctgcaggacagcggcctggaggtgaacatcgtgaccgacagccagtacgccctgggcatcatccaggcccagcccgacaagagcgagagcgagctggtgagccagatcatcgagcagctgatcaagaaggagaaggtgtacctggcctgggtgcccgcccacaagggcatcggcggcaacgagcaggtggacggcctggtgagcgccggcatccgcaaggtgctgttcctggacggcatcgacaaggcccaggaggagcacgagaagtaccacagcaactggcgcgccatggccagcgacttcaacctgccccccgtggtggccaaggagatcgtggccagctgcgacaagtgccagctgaagggcgaggccatgcacggccaggtggactgcagccccggcatctggcagctggcatgcacccacctggagggcaaggtgatcctggtggccgtgcacgtggccagcggctacatcgaggccgaggtgatccccgccgagaccggccaggagaccgcctacttcctgctgaagctggccggccgctggcccgtgaagaccgtgcacaccgacaacggcagcaacttcaccagcaccaccgtgaaggccgcctgctggtgggccggcatcaagcaggagttcggcatcccctacaacccccagagccagggcgtgatcgagagcatgaacaaggagctgaagaagatcatcggccaggtgcgcgaccaggccgagcacctgaagaccgccgtgcagatggccgtgttcatccacaacttcaagcgcaagggcggcatcggcggctacagcgccggcgagcgcatcgtggacatcatcgccaccgacatccagaccaaggagctgcagaagcagatcaccaagatccagaacttccgcgtgtactaccgcgacagccgcgaccccgtgtggaagggccccgccaagctgctgtggaagggcgagggcgccgtggtgatccaggacaacagcgacatcaaggtggtgccccgccgcaaggccaagatcatccgcgactacggcaagcagatggccggcgacgactgcgtggccagccgccaggacgaggactaggaattcttgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaatttcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 174 - DNA, 9788 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacatgggcgcccgcgccagcatcctgcgcggcggcaagctggacgcctgggagcgcatcaagctgaagcccggcggcaagaagcactacatgatgaagcacctggtgtgggccagccgcgagctggagcgcttcgccctggaccccggcctgctggagaccagcgagggctgcaagcagatcatgaagcagctgcagcccgccctgcagaccggcaccaaggagctgatcagcctgcacaacaccgtggccaccctgtactgcgtgcacgagaagatcgacgtgcgcgacaccaaggaggccctggacaagatcaaggaggagcagaacaagagccagcagaagacccagcaggccgaggccgccgacaagggcaaggtgagccagaactaccccatcgtgcagaacctgcagggccagatggtgcaccagcccatcagcgcccgcaccctgaacgcctgggtgaaggtggtggaggagaaggccttcagccccgaggtgatccccatgttcaccgccctgagcgagggcgccaccccccaggacctgaacaccatgctgaacaccgtgggcggccaccaggccgccatgcagatgctgaaggacaccatcaacgaggaggccgccgagtgggaccgcctgcaccccgtgcacgccggccccgtggcccccggccagatgcgcgagccccgcggcagcgacatcgccggcaccaccagcaccctgcaggagcagatcacctggatgaccaacaacccccccgtgcccgtgggcgacatctacaagcgctggatcatcctgggcctgaacaagatcgtgcgcatgtacagccccgtgagcatcctggacatcaagcagggccccaaggagcccttccgcgactacgtggaccgcttcttcaagaccctgcgcgccgagcaggccacccaggacgtgaagaactggatgaccgacaccctgctggtgcagaacgccaaccccgactgcaagaccatcctgcgcgccctgggccccggcgccagcctggaggagatgatgaccgcctgccagggcgtgggcggccccggccacaaggcccgcgtgctggccgaggccatgagcaaggtgaacaacaccaacatcatgatgcagcgcagcaactgcaagggccccaagcgcaccatcaagtgcttcaactgcggcaaggagggccacctggcccgcaactgccgcgccccccgcaagaagggctgctggaagtgcggcaaggagggccaccaggtgaaggactgcaccgagcgacaggctaatagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagatagggggccagctgaaggaggcccttctagacaccggcgccgacgacaccgtgctggaggagatgaacctgcccggccgctggaagcccaagatgatcggcggcatcggcggcttcatcaaggtgggccagtacgaccagatcctgatcgagatctgcggccacaaggccatcggcaccgtgctggtgggccccacccccgtgaacatcatcggccgcaacctgctgacccagatcggctgcaccctgaacttccccatcagccccatcgagaccgtgcccgtgaagctgaagcccggcatggacggccccaaggtgaagcagtggcccctgaccgaggagaagatcaaggccctggtggagatctgcaccgagatggagaaggagggcaagatcagcaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagcagaagaagagcgtgaccgtgctggacgtgggcgacgcctacttcagcgtgcccctggacaaggacttccgcaagtacaccgccttcaccatccccagcatcaacaacgagacccccggcatccgctaccagtacaacgtgctgccccagggctggaagggcagccccgccatcttccagtgcagcatgaccaagatcctggagcccttccgcaagcagaaccccgacatcgtgatctaccagtacatggaccacctgtacgtgggcagcgacctggagatcggccagcaccgcaccaagatcgaggagctgcgccagcacctgctgcgctggggcttcaccacccccgacaagaagcaccagaaggagccccccttcctgtggatgggctacgagctgcaccccgacaagtggaccgtgcagcccatcgtgctgcccgagaaggacagctggaccgtgaacgacatccagaagctggtgggcaagctgaactgggccagccagatctacgccggcatcaaggtgcgccagctgtgcaagctgctgcgcggcaccaaggccctgaccgaggtggtgcccctgaccgaggaggccgagctggagctggccgagaaccgcgagatcctgaaggagcccgtgcacggcgtgtactacgaccccagcaaggacctgatcgccgagatccagaagcagggccagggccagtggacctaccagatctaccaggagcccttcaagaacctgaagaccggcaagtacgcccgcatgaagggcgcccacaccaacgacgtgaagcagctgaccgaggccgtgcagaagatcgccaccgagagcatcgtgatctggggcaagacccccaagttcaagctgcccatccagaaggagacctgggaggcctggtggaccgagtactggcaggccacctggatccccgagtgggagttcgtgaacaccccccccctggtgaagctgtggtaccagctggagaaggagcccatcatcggcgccgagaccttctacgtggacggcgccgccaaccgcgagaccaagctgggcaaggccggctacgtgaccgaccgcggccgccagaaggtggtgcccctgaccgacaccaccaaccagaagaccgagctgcaggccatccacctggccctgcaggacagcggcctggaggtgaacatcgtgaccgacagccagtacgccctgggcatcatccaggcccagcccgacaagagcgagagcgagctggtgagccagatcatcgagcagctgatcaagaaggagaaggtgtacctggcctgggtgcccgcccacaagggcatcggcggcaacgagcaggtggacggcctggtgagcgccggcatccgcaaggtgctgttcctggacggcatcgacaaggcccaggaggagcacgagaagtaccacagcaactggcgcgccatggccagcgacttcaacctgccccccgtggtggccaaggagatcgtggccagctgcgacaagtgccagctgaagggcgaggccatgcacggccaggtggactgcagccccggcatctggcagctggcatgcacccacctggagggcaaggtgatcctggtggccgtgcacgtggccagcggctacatcgaggccgaggtgatccccgccgagaccggccaggagaccgcctacttcctgctgaagctggccggccgctggcccgtaaagaccgtgcacaccgacaacggcagcaacttcaccagcaccaccgtgaaggccgcctgctggtgggccggcatcaagcaggagttcggcatcccctacaacccccagagccagggcgtgatcgagagcatgaacaaggagctgaagaagatcatcggccaggtgcgcgaccaggccgagcacctgaagaccgccgtgcagatggccgtgttcatccacaacttcaagcgcaagggcggcatcggcggctacagcgccggcgagcgcatcgtggacatcatcgccaccgacatccagaccaaggagctgcagaagcagatcaccaagatccagaacttccgcgtgtactaccgcgacagccgcgaccccgtgtggaagggccccgccaagctgctgtggaagggcgagggcgccgtggtgatccaggacaacagcgacatcaaggtggtgccccgccgcaaggccaagatcatccgcgactacggcaagcagatggccggcgacgactgcgtggccagccgccaggacgaggacatgggtaataaatggagcaagtgtagcactgtgggccgccctgccatcagggagagaatgcgccgcgcccccgcagccgaaggagtgggtccagcttcacaggatagtgacaaatacggcgctctgacatccagcagtacccccgctaacaacgccgactgtgcatggctcgaagcccagcaggaagaagaggaggtcggattccctgtgaggcctcaggttcctctcagacctatgacttacaaggccgtggtcgacttgtcttttttccttgaagagaagggaggcttggaggggctgatttacagcaagaagcgccaggatattttggatttgtgggtctacaacacacagggttacttccccgattggcagaactacacccccggcccaggcgtgcggtttcctcttacctttggttggtgctttaagctcgtgcctgtcgatcctagagaagtggaggaagcaaacacaggcgagaacaacagtctgctgcatcctatgagccttcatggcatggaggattctcatcgggaagtgcttcagtggaaattcgatagcttgctcgctagaagacacatggctcgggagttgcatcctgagtattataaggattgttgaacacgtggcgaattcttgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaatttcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 175 - DNA, 9407 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacatggcccgcgccagcgtgctgagcggcggcgagctggaccgctgggagaagatccgcctgcgccccggcggcaagaagaagtacaagctgaagcacatcgtgtgggccagccgcgagctggagcgcttcgccgtgaaccccggcctgctggagaccagcgagggctgccgccagatcctgggccagctgcagcccagcctgcagaccggcagcgaggagctgcgcagcctgtacaacaccgtggccaccctgtactgcgtgcaccagcgcatcgagatcaaggacaccaaggaggccctggacaagatcgaggaggagcagaacaagagcaagaagaaggcccagcaggccgccgccgacaccggccacagcaaccaggtgagccagaactaccccatcgtgcagaacatccagggccagatggtgcaccaggccatcagcccccgcaccctgaacgcctgggtgaaggtggtggaggagaaggccttcagccccgaggtgatccccatgttcagcgccctgagcgagggcgccaccccccaggacctgaacaccatgctgaacaccgtgggcggccaccaggccgccatgcagatgctgaaggagaccatcaacgaggaggccgccgagtgggaccgcgtgcaccccgtgcacgccggccccatcgcccccggccagatgcgcgagccccgcggcagcgacatcgccggcaccaccagcaccctgcaggagcagatcggctggatgaccaacaacccccccatccccgtgggcgagatctacaagcgctggatcatcctgggcctgaacaagatcgtgcgcatgtacagccccaccagcatcctggacatccgccagggccccaaggagcccttccgcgactacgtggaccgcttctacaagaccctgcgcgccgagcaggccagccaggaggtgaagaactggatgaccgagaccctgctggtgcagaacgccaaccccgactgcaagaccatcctgaaggccctgggccccgccgccaccctggaggagatgatgaccgcctgccagggcgtgggcggccccggccacaaggcccgcgtgctggccgaggccatgagccaggtgaccaacagcgccaccatcatgatgcagcgcggcaacttccgcaaccagcgcaagatcgtgaagtgcttcaactgcggcaaggagggccacaccgcccgcaactgccgcgccccccgcaagaagggctgctggaagtgcggcaaggagggccaccagatgaaggactgcaccgagcgacaggctaataacgccgcctgcgcctggctggaggcccaggaggaggaggaggtgggcttccccgtgaccccccaggtgcccctgcgccccatgacctacaaggccgccgtggacctgagccacttcctgaaggagaagggcggcctggagggcctgatccacagccagcgccgccaggacatcctggacctgtggatctaccacacccagggctacttccccgactggcagaactacacccccggccccggcgtgcgctaccccctgaccttcggctggtgctacaagctggtgcccgtggagcccgacaaggtggaggaggccaacaagggcgagaacaccagcctgctgcaccccgtgagcctgcacggcatggacgaccccgagcgcgaggtgctggagtggcgcttcgacagccgcctggccttccaccacgtggcccgcgagctgcaccccgagtacttcaagaactgcgcccttctagacaccggcgccgacgacaccgtgctggaggagatgaacctgcccggccgctggaagcccaagatgatcggcggcatcggcggcttcatcaaggtgggccagtacgaccagatcctgatcgagatctgcggccacaaggccatcggcaccgtgctggtgggccccacccccgtgaacatcatcggccgcaacctgctgacccagatcggctgcaccctgaacttccccatcagccccatcgagaccgtgcccgtgaagctgaagcccggcatggacggccccaaggtgaagcagtggcccctgaccgaggagaagatcaaggccctggtggagatctgcaccgagatggagaaggagggcaagatcagcaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagcagaagaagagcgtgaccgtgctggacgtgggcgacgcctacttcagcgtgcccctggacaaggacttccgcaagtacaccgccttcaccatccccagcatcaacaacgagacccccggcatccgctaccagtacaacgtgctgccccagggctggaagggcagccccgccatcttccagtgcagcatgaccaagatcctggagcccttccgcaagcagaaccccgacatcgtgatctaccagtacatggaccacctgtacgtgggcagcgacctggagatcggccagcaccgcaccaagatcgaggagctgcgccagcacctgctgcgctggggcttcaccacccccgacaagaagcaccagaaggagccccccttcctgtggatgggctacgagctgcaccccgacaagtggaccgtgcagcccatcgtgctgcccgagaaggacagctggaccgtgaacgacatccagaagctggtgggcaagctgaactgggccagccagatctacgccggcatcaaggtgcgccagctgtgcaagctgctgcgcggcaccaaggccctgaccgaggtggtgcccctgaccgaggaggccgagctggagctggccgagaaccgcgagatcctgaaggagcccgtgcacggcgtgtactacgaccccagcaaggacctgatcgccgagatccagaagcagggccagggccagtggacctaccagatctaccaggagcccttcaagaacctgaagaccggcaagtacgcccgcatgaagggcgcccacaccaacgacgtgaagcagctgaccgaggccgtgcagaagatcgccaccgagagcatcgtgatctggggcaagacccccaagttcaagctgcccatccagaaggagacctgggaggcctggtggaccgagtactggcaggccacctggatccccgagtgggagttcgtgaacaccccccccctggtgaagctgtggtaccagctggagaaggagcccatcatcggcgccgagaccttctacgtggacggcgccgccaaccgcgagaccaagctgggcaaggccggctacgtgaccgaccgcggccgccagaaggtggtgcccctgaccgacaccaccaaccagaagaccgagctgcaggccatccacctggccctgcaggacagcggcctggaggtgaacatcgtgaccgacagccagtacgccctgggcatcatccaggcccagcccgacaagagcgagagcgagctggtgagccagatcatcgagcagctgatcaagaaggagaaggtgtacctggcctgggtgcccgcccacaagggcatcggcggcaacgagcaggtggacggcctggtgagcgccggcatccgcaaggtgctgttcctggacggcatcgacaaggcccaggaggagcacgagaagtaccacagcaactggcgcgccatggccagcgacttcaacctgccccccgtggtggccaaggagatcgtggccagctgcgacaagtgccagctgaagggcgaggccatgcacggccaggtggactgcagccccggcatctggcagctggcatgcacccacctggagggcaaggtgatcctggtggccgtgcacgtggccagcggctacatcgaggccgaggtgatccccgccgagaccggccaggagaccgcctacttcctgctgaagctggccggccgctggcccgtgaagaccgtgcacaccgacaacggcagcaacttcaccagcaccaccgtgaaggccgcctgctggtgggccggcatcaagcaggagttcggcatcccctacaacccccagagccagggcgtgatcgagagcatgaacaaggagctgaagaagatcatcggccaggtgcgcgaccaggccgagcacctgaagaccgccgtgcagatggccgtgttcatccacaacttcaagcgcaagggcggcatcggcggctacagcgccggcgagcgcatcgtggacatcatcgccaccgacatccagaccaaggagctgcagaagcagatcaccaagatccagaacttccgcgtgtactaccgcgacagccgcgaccccgtgtggaagggccccgccaagctgctgtggaagggcgagggcgccgtggtgatccaggacaacagcgacatcaaggtggtgccccgccgcaaggccaagatcatccgcgactacggcaagcagatggccggcgacgactgcgtggccagccgccaggacgaggactaggaattcttgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaatttcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 176 - DNA, 9785 bp, Artificial Sequence
  plasmid pVR1012x/s containing HIV genes
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacatgggcgcccgcgccagcgtgctgagcggcggcaagttcgacgcctgggagaagatccgcctgcgccccggcggcaagaagaagtaccgcatgaagcacctgatctgggccagccgcgagctggaccgcttcgccctgaaccccagcctgctggagaccgccgacggctgccagcagatcatggagaagctgcagcccgccctgaagaccggcaccgaggagatcaagagcctgttcaacaccgtggccaccctgtactgcgtgcaccagcgcatcgacgtgaaggacaccaaggaggccctggacaagatcgaggagatcaagaacaagagcaagcagaagacccagcaggccgccgccgacaccggcaacagcagcaacgtgagccagaactaccccatcgtgcagaacgcccagggccagatgatccaccagagcctgagcccccgcaccctgaacgcctgggtgaaggtgatcgaggagaaggccttcagccccgaggtgatccccatgttcagcgccctgagcgagggcgccaccccccaggacctgaacatgatgctgaacatcgtgggcggccaccaggccgccatgcagatgctgaaggacaccatcaacgaggaggccgccgagtgggaccgcctgcaccccgtgcacgccggccccatcccccccggccagatgcgcgagccccgcggcagcgacatcgccggcaccaccagcaccccccaggagcagatcggctggatgaccggcaacccccccatccccgtgggcgacatctacaagcgctggatcatcctgggcctgaacaagatcgtgcgcatgtacagccccgtgagcatcctggacatcaagcagggccccaaggagcccttccgcgactacgtggaccgcttcttcaagaccttccgcgccgagcaggccacccaggacgtgaagaactggatgaccgacaccctgctggtgcagaacgccaaccccgactgcaaggccatcctgcgcgccctgggccccggcgccaccctggaggagatgatgaccgcctgccagggcgtgggcggccccggccacaaggcccgcgtgctggccgaggccatgagccaggtgcagcacaccaacatcatgatgcagcgcggcaacttcaagggccagaagcgcatcaagtgcttcaactgcggcaaggagggccacctggcccgcaactgccgcgccctgcgcaagaagggctgctggaagtgcggcaaggagggccaccagatgaaggactgcaccgagcgacaggctaatagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagatagggggccagctgaaggaggcccttctagacaccggcgccgacgacaccgtgctggaggagatgaacctgcccggccgctggaagcccaagatgatcggcggcatcggcggcttcatcaaggtgggccagtacgaccagatcctgatcgagatctgcggccacaaggccatcggcaccgtgctggtgggccccacccccgtgaacatcatcggccgcaacctgctgacccagatcggctgcaccctgaacttccccatcagccccatcgagaccgtgcccgtgaagctgaagcccggcatggacggccccaaggtgaagcagtggcccctgaccgaggagaagatcaaggccctggtggagatctgcaccgagatggagaaggagggcaagatcagcaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagcagaagaagagcgtgaccgtgctggacgtgggcgacgcctacttcagcgtgcccctggacaaggacttccgcaagtacaccgccttcaccatccccagcatcaacaacgagacccccggcatccgctaccagtacaacgtgctgccccagggctggaagggcagccccgccatcttccagtgcagcatgaccaagatcctggagcccttccgcaagcagaaccccgacatcgtgatctaccagtacatggaccacctgtacgtgggcagcgacctggagatcggccagcaccgcaccaagatcgaggagctgcgccagcacctgctgcgctggggcttcaccacccccgacaagaagcaccagaaggagccccccttcctgtggatgggctacgagctgcaccccgacaagtggaccgtgcagcccatcgtgctgcccgagaaggacagctggaccgtgaacgacatccagaagctggtgggcaagctgaactgggccagccagatctacgccggcatcaaggtgcgccagctgtgcaagctgctgcgcggcaccaaggccctgaccgaggtggtgcccctgaccgaggaggccgagctggagctggccgagaaccgcgagatcctgaaggagcccgtgcacggcgtgtactacgaccccagcaaggacctgatcgccgagatccagaagcagggccagggccagtggacctaccagatctaccaggagcccttcaagaacctgaagaccggcaagtacgcccgcatgaagggcgcccacaccaacgacgtgaagcagctgaccgaggccgtgcagaagatcgccaccgagagcatcgtgatctggggcaagacccccaagttcaagctgcccatccagaaggagacctgggaggcctggtggaccgagtactggcaggccacctggatccccgagtgggagttcgtgaacaccccccccctggtgaagctgtggtaccagctggagaaggagcccatcatcggcgccgagaccttctacgtggacggcgccgccaaccgcgagaccaagctgggcaaggccggctacgtgaccgaccgcggccgccagaaggtggtgcccctgaccgacaccaccaaccagaagaccgagctgcaggccatccacctggccctgcaggacagcggcctggaggtgaacatcgtgaccgacagccagtacgccctgggcatcatccaggcccagcccgacaagagcgagagcgagctggtgagccagatcatcgagcagctgatcaagaaggagaaggtgtacctggcctgggtgcccgcccacaagggcatcggcggcaacgagcaggtggacggcctggtgagcgccggcatccgcaaggtgctgttcctggacggcatcgacaaggcccaggaggagcacgagaagtaccacagcaactggcgcgccatggccagcgacttcaacctgccccccgtggtggccaaggagatcgtggccagctgcgacaagtgccagctgaagggcgaggccatgcacggccaggtggactgcagccccggcatctggcagctggcatgcacccacctggagggcaaggtgatcctggtggccgtgcacgtggccagcggctacatcgaggccgaggtgatccccgccgagaccggccaggagaccgcctacttcctgctgaagctggccggccgctggcccgtgaagaccgtgcacaccgacaacggcagcaacttcaccagcaccaccgtgaaggccgcctgctggtgggccggcatcaagcaggagttcggcatcccctacaacccccagagccagggcgtgatcgagagcatgaacaaggagctgaagaagatcatcggccaggtgcgcgaccaggccgagcacctgaagaccgccgtgcagatggccgtgttcatccacaacttcaagcgcaagggcggcatcggcggctacagcgccggcgagcgcatcgtggacatcatcgccaccgacatccagaccaaggagctgcagaagcagatcaccaagatccagaacttccgcgtgtactaccgcgacagccgcgaccccgtgtggaagggccccgccaagctgctgtggaagggcgagggcgccgtggtgatccaggacaacagcgacatcaaggtggtgccccgccgcaaggccaagatcatccgcgactacggcaagcagatggccggcgacgactgcgtggccagccgccaggacgaggacatgggcagcaagtggagcaagagcagcatcgtgggctggagggaggtgagggagaggctgaggcagaccctggccgccgccagaggcgtgggcgccgtgagccaggacctggagaagtacggcgccgtgaccagcagcaacgtgaaccaccctagctgcgcctggctggaggcccaggaggaggaggaggtgggcttccctgtgaggcctcacgtgcctctgaggcctatgacctacaagggcgccctggacctgagccacttcctgaaggagaagggcggcctggacggcctgatctacagcaggaggaggcaggagatcctggacctgtgggtgtacaacacccagggctacttccctgactggcagaactacacacccggccctggcgtgaggtaccctctgaccttcggctggtgcttcaagctggtgcctgtggaccctgacgaggtggagcaggccaacgagggcgagaacaacagcctgctgcaccctatgtgccagcacggcatggacgacgaggagaaggagaccctgaggtggaggttcgacagcaggctggccctgaggcacagggcccaggagatgcaccctgagttctacaaggactgctgaacacgtggcgaattcttgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaatttcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

What is claimed is:

1. A nucleic acid molecule comprising a polynucleotide encoding a ΔCFI HIV Env glycoprotein in which the cleavage site, fusion domain, and at least part of the interspace between the two heptad-repeats are deleted.

2. The nucleic acid molecule of claim 1, wherein said ΔCFI HIV Env glycoprotein is further a COOH-terminal truncation in which the cytoplasmic domain is deleted.

3. The nucleic acid molecule of claim 1 or 2 further comprising a backbone, wherein said backbone is a plasmid vector.

4. The nucleic acid molecule of claim 1 or 2 further comprising a backbone, wherein said backbone is an adenoviral vector.

5. A composition that generates an antibody or CTL response against native HIV Env comprising the nucleic acid molecule of any one of claims 1, 2, 3, or 4.

* * * * *